US012612618B2

(12) United States Patent
Slaymaker et al.

(10) Patent No.: US 12,612,618 B2
(45) Date of Patent: Apr. 28, 2026

(54) NUCLEOBASE EDITORS HAVING REDUCED NON-TARGET DEAMINATION AND ASSAYS FOR CHARACTERIZING NUCLEOBASE EDITORS

(71) Applicant: BEAM THERAPEUTICS INC., Cambridge, MA (US)

(72) Inventors: Ian Slaymaker, Cambridge, MA (US); Jason Michael Gehrke, Cambridge, MA (US); Nicole Gaudelli, Cambridge, MA (US); Yi Yu, Cambridge, MA (US)

(73) Assignee: Beam Therapeutics Inc., Cambridge, MA (US)

( * ) Notice: Subject to any disclaimer, the term of this patent is extended or adjusted under 35 U.S.C. 154(b) by 1257 days.

(21) Appl. No.: 17/427,410

(22) PCT Filed: Jan. 31, 2020

(86) PCT No.: PCT/US2020/016285
§ 371 (c)(1),
(2) Date: Jul. 30, 2021

(87) PCT Pub. No.: WO2020/160514
PCT Pub. Date: Aug. 6, 2020

(65) Prior Publication Data
US 2022/0098572 A1      Mar. 31, 2022

Related U.S. Application Data

(60) Provisional application No. 62/799,702, filed on Jan. 31, 2019.

(51) Int. Cl.
| | |
|---|---|
| *C12N 9/22* | (2006.01) |
| *C12N 9/80* | (2006.01) |
| *C12N 15/10* | (2006.01) |
| *C12N 15/11* | (2006.01) |
| *C12N 15/62* | (2006.01) |
| *C40B 40/10* | (2006.01) |

(52) U.S. Cl.
CPC ............. *C12N 15/102* (2013.01); *C12N 9/22* (2013.01); *C12N 9/80* (2013.01); *C12N 15/111* (2013.01); *C12N 15/62* (2013.01); *C40B 40/10* (2013.01); *C12N 2310/20* (2017.05); *C12N 2320/11* (2013.01); *C12Y 305/04005* (2013.01)

(58) Field of Classification Search
None
See application file for complete search history.

(56) References Cited

U.S. PATENT DOCUMENTS

| | | | |
|---|---|---|---|
| 7,707,676 B2 | 5/2010 | Solanki | |
| 7,915,114 B2 | 3/2011 | Hsiao et al. | |
| 9,068,179 B1 | 6/2015 | Liu et al. | |
| 9,322,037 B2 | 4/2016 | Liu et al. | |
| 9,388,430 B2 | 7/2016 | Liu et al. | |
| 9,512,446 B1 | 12/2016 | Joung et al. | |
| 9,737,604 B2 | 8/2017 | Liu et al. | |
| 9,840,699 B2 | 12/2017 | Liu et al. | |
| 10,113,163 B2 | 10/2018 | Liu et al. | |
| 10,167,457 B2 | 1/2019 | Liu et al. | |
| 10,465,176 B2 | 11/2019 | Liu et al. | |
| 10,526,401 B2 | 1/2020 | Muir et al. | |
| 10,682,410 B2 | 6/2020 | Liu et al. | |
| 10,745,677 B2 | 8/2020 | Maianti et al. | |
| 10,912,833 B2 | 2/2021 | Liu et al. | |
| 10,947,530 B2 | 3/2021 | Liu et al. | |
| 11,053,481 B2 | 7/2021 | Liu et al. | |
| 11,124,782 B2 | 9/2021 | Liu et al. | |
| 11,142,550 B2 | 10/2021 | Muir et al. | |
| 11,155,803 B2 | 10/2021 | Gaudelli et al. | |
| 11,193,123 B2 | 12/2021 | Halperin | |
| 11,214,780 B2 | 1/2022 | Liu et al. | |
| 11,268,082 B2 | 3/2022 | Liu et al. | |
| 11,306,324 B2 | 4/2022 | Liu et al. | |
| 11,319,532 B2 | 5/2022 | Liu et al. | |
| 11,479,767 B2 | 10/2022 | Smith et al. | |
| 11,542,496 B2 | 1/2023 | Liu et al. | |
| 11,732,274 B2 | 8/2023 | Liu et al. | |
| 12,129,478 B1 | 10/2024 | Chen et al. | |
| 12,241,096 B2 | 3/2025 | Joung et al. | |
| 2004/0003420 A1 | 1/2004 | Kuhn et al. | |
| 2004/0115184 A1 | 6/2004 | Smith et al. | |
| 2005/0222030 A1 | 10/2005 | Allison | |
| 2011/0104787 A1 | 5/2011 | Church et al. | |
| 2014/0068797 A1 | 3/2014 | Doudna et al. | |
| 2014/0186958 A1 | 7/2014 | Zhang et al. | |
| 2014/0273226 A1 | 9/2014 | Wu | |
| 2014/0273230 A1 | 9/2014 | Chen et al. | |
| 2014/0356956 A1 | 12/2014 | Church et al. | |
| 2015/0071903 A1 | 3/2015 | Liu et al. | |
| 2015/0165054 A1 | 6/2015 | Liu et al. | |
| 2015/0166980 A1 | 6/2015 | Liu et al. | |
| 2015/0166982 A1 | 6/2015 | Liu et al. | |
| 2015/0166984 A1 | 6/2015 | Liu et al. | |

(Continued)

FOREIGN PATENT DOCUMENTS

| | | |
|---|---|---|
| CN | 103088008 A | 5/2013 |
| CN | 105934516 A | 9/2016 |

(Continued)

OTHER PUBLICATIONS

Rees and Liu, Base editing: precision chemistry on the genome and transcriptome of living cells. Nature Reviews Genetics (2018), 19: 770-788 (Year: 2018).*

(Continued)

*Primary Examiner* — Catherine Konopka
(74) *Attorney, Agent, or Firm* — Greenberg Traurig, LLP; Melissa Hunter-Ensor; Nicholas R. Ballor

(57) ABSTRACT

The invention features base editors having reduced non-target deamination, methods of using the base editors, and assays for characterizing base editors as having decreased non-target deamination, e.g. compared to programmed, on-target deamination.

16 Claims, 52 Drawing Sheets

Specification includes a Sequence Listing.

(56) References Cited

U.S. PATENT DOCUMENTS

| | | | |
|---|---|---|---|
| 2015/0166985 A1 | 6/2015 | Liu et al. | |
| 2015/0344549 A1 | 12/2015 | Muir et al. | |
| 2016/0046961 A1 | 2/2016 | Jinek et al. | |
| 2016/0200779 A1 | 7/2016 | Liu et al. | |
| 2016/0208243 A1 | 7/2016 | Zhang et al. | |
| 2016/0304846 A1 | 10/2016 | Liu et al. | |
| 2016/0355797 A1* | 12/2016 | Konermann | C12N 15/902 |
| 2017/0121693 A1 | 5/2017 | Liu et al. | |
| 2017/0275648 A1 | 9/2017 | Barrangou et al. | |
| 2018/0002736 A1* | 1/2018 | O'Connell | C12Q 1/6818 |
| 2018/0073012 A1* | 3/2018 | Liu | A61P 43/00 |
| 2018/0170984 A1* | 6/2018 | Harris | C07K 14/4703 |
| 2018/0179503 A1 | 6/2018 | Maianti et al. | |
| 2018/0216095 A1 | 8/2018 | Thanos et al. | |
| 2018/0237787 A1 | 8/2018 | Maianti et al. | |
| 2018/0298421 A1 | 10/2018 | Carpenter et al. | |
| 2018/0312828 A1 | 11/2018 | Liu et al. | |
| 2019/0002875 A1 | 1/2019 | Cheng et al. | |
| 2019/0010471 A1 | 1/2019 | Zhang et al. | |
| 2019/0010481 A1 | 1/2019 | Joung et al. | |
| 2019/0093099 A1 | 3/2019 | Liu et al. | |
| 2019/0225955 A1 | 7/2019 | Liu et al. | |
| 2019/0367891 A1 | 12/2019 | Liu et al. | |
| 2019/0382775 A1* | 12/2019 | Tan | C07K 16/1275 |
| 2020/0063127 A1 | 2/2020 | Lu et al. | |
| 2020/0190493 A1 | 6/2020 | Liu et al. | |
| 2020/0199552 A1* | 6/2020 | Oakes | C12N 15/113 |
| 2020/0308571 A1 | 10/2020 | Joung et al. | |
| 2020/0399619 A1 | 12/2020 | Maianti et al. | |
| 2021/0317440 A1 | 10/2021 | Liu et al. | |
| 2022/0047637 A1 | 2/2022 | Lamothe-Dreuzy et al. | |
| 2022/0119785 A1 | 4/2022 | Liu et al. | |
| 2022/0136012 A1 | 5/2022 | Gaudelli et al. | |
| 2022/0169998 A1 | 6/2022 | Joung et al. | |
| 2022/0220462 A1 | 7/2022 | Liu et al. | |
| 2022/0290115 A1 | 9/2022 | Liu et al. | |
| 2022/0290134 A1 | 9/2022 | Jin et al. | |
| 2022/0290164 A1 | 9/2022 | Ran et al. | |
| 2022/0307003 A1 | 9/2022 | Liu | |
| 2023/0108687 A1 | 4/2023 | Liu et al. | |
| 2023/0348883 A1 | 11/2023 | Liu et al. | |
| 2023/0407277 A1 | 12/2023 | Joung et al. | |

FOREIGN PATENT DOCUMENTS

| | | | | | |
|---|---|---|---|---|---|
| CN | 108290933 A | 7/2018 | | | |
| CN | 108699116 A | 10/2018 | | | |
| EP | 2877490 B1 | 9/2018 | | | |
| EP | 3956349 A1 | 2/2022 | | | |
| JP | 2017500035 A | 1/2017 | | | |
| JP | 6629734 A2 | 1/2020 | | | |
| KR | 20160050069 A | 5/2016 | | | |
| WO | 1997025416 A2 | 7/1997 | | | |
| WO | 2001038547 A2 | 5/2001 | | | |
| WO | 2002068676 A2 | 9/2002 | | | |
| WO | 2002103028 A2 | 12/2002 | | | |
| WO | 2010132092 A2 | 11/2010 | | | |
| WO | 2011075627 A1 | 6/2011 | | | |
| WO | 2013045632 A1 | 4/2013 | | | |
| WO | 2013176772 A1 | 11/2013 | | | |
| WO | 2013188037 A2 | 12/2013 | | | |
| WO | 2014004336 A2 | 1/2014 | | | |
| WO | 2014089290 A1 | 6/2014 | | | |
| WO | 2014184143 A1 | 11/2014 | | | |
| WO | 2014184741 A1 | 11/2014 | | | |
| WO | 2014186686 A2 | 11/2014 | | | |
| WO | 2015006294 A2 | 1/2015 | | | |
| WO | 2015021426 A1 | 2/2015 | | | |
| WO | 2015089277 A1 | 6/2015 | | | |
| WO | 2015089406 A1 | 6/2015 | | | |
| WO | 2015090230 A1 | 6/2015 | | | |
| WO | 2015092024 A2 | 6/2015 | | | |
| WO | 2015133554 A1 | 9/2015 | | | |
| WO | 2015142675 A2 | 9/2015 | | | |
| WO | 2016011210 A2 | 1/2016 | | | |
| WO | 2016016343 A1 | 2/2016 | | | |
| WO | 2016061368 A1 | 4/2016 | | | |
| WO | 2016069910 A1 | 5/2016 | | | |
| WO | 2016072399 A1 | 5/2016 | | | |
| WO | 2016073649 A1 | 5/2016 | | | |
| WO | 2016075612 A1 | 5/2016 | | | |
| WO | 2016094304 A2 | 6/2016 | | | |
| WO | 2016138038 A1 | 9/2016 | | | |
| WO | 2016142532 A2 | 9/2016 | | | |
| WO | 2016172727 A1 | 10/2016 | | | |
| WO | 2016183438 A1 | 11/2016 | | | |
| WO | 2016196308 A1 | 12/2016 | | | |
| WO | 2016196388 A1 | 12/2016 | | | |
| WO | 2016205711 A1 | 12/2016 | | | |
| WO | WO-2016196655 A1 * | 12/2016 | | | C12N 15/102 |
| WO | 2017011721 A1 | 1/2017 | | | |
| WO | 2017048969 A1 | 3/2017 | | | |
| WO | 2017049166 A1 | 3/2017 | | | |
| WO | 2017070632 A2 | 4/2017 | | | |
| WO | 2017070633 A2 | 4/2017 | | | |
| WO | 2017079703 A1 | 5/2017 | | | |
| WO | 2017079705 A1 | 5/2017 | | | |
| WO | 2017132580 A2 | 8/2017 | | | |
| WO | 2017180993 A1 | 10/2017 | | | |
| WO | 2018027036 A1 | 2/2018 | | | |
| WO | 2018027078 A1 | 2/2018 | | | |
| WO | 2018085690 A1 | 5/2018 | | | |
| WO | 2018089664 A1 | 5/2018 | | | |
| WO | 2018119354 A1 | 6/2018 | | | |
| WO | 2018119359 A1 | 6/2018 | | | |
| WO | 2018129129 A1 | 7/2018 | | | |
| WO | 2018/176009 A1 | 9/2018 | | | |
| WO | 2018165629 A1 | 9/2018 | | | |
| WO | 2018213726 A1 | 11/2018 | | | |
| WO | 2018218188 A2 | 11/2018 | | | |
| WO | 2019005884 A1 | 1/2019 | | | |
| WO | 2019005886 A1 | 1/2019 | | | |
| WO | 2019023680 A1 | 1/2019 | | | |
| WO | 2019120310 A1 | 6/2019 | | | |
| WO | 2019139645 A2 | 7/2019 | | | |
| WO | 2019226953 A1 | 11/2019 | | | |
| WO | 2020028823 A1 | 2/2020 | | | |
| WO | 2020041751 A1 | 2/2020 | | | |
| WO | 2020051561 A1 | 3/2020 | | | |
| WO | 2020160514 A1 | 8/2020 | | | |
| WO | 2020160517 A1 | 8/2020 | | | |
| WO | 2020163396 A1 | 8/2020 | | | |
| WO | 2020168051 A1 | 8/2020 | | | |
| WO | 2020168075 A1 | 8/2020 | | | |
| WO | 2020168088 A1 | 8/2020 | | | |
| WO | 2020168122 A1 | 8/2020 | | | |
| WO | 2020168132 A1 | 8/2020 | | | |
| WO | 2020168133 A1 | 8/2020 | | | |
| WO | 2020168135 A1 | 8/2020 | | | |
| WO | 2020214842 A1 | 10/2020 | | | |
| WO | 2021020884 A2 | 2/2021 | | | |
| WO | 2021050571 A1 | 3/2021 | | | |
| WO | 2021055459 A1 | 3/2021 | | | |
| WO | 2021087182 A1 | 5/2021 | | | |
| WO | 2021108717 A2 | 6/2021 | | | |
| WO | 2021158921 A2 | 8/2021 | | | |
| WO | 2021175288 A1 | 9/2021 | | | |
| WO | 2021207651 A2 | 10/2021 | | | |
| WO | 2022008935 A1 | 1/2022 | | | |
| WO | 2022015969 A1 | 1/2022 | | | |
| WO | 2022056254 A2 | 3/2022 | | | |
| WO | 2022056324 A1 | 3/2022 | | | |
| WO | 2022112404 A1 | 6/2022 | | | |
| WO | 2022148955 A1 | 7/2022 | | | |
| WO | 2022150367 A1 | 7/2022 | | | |
| WO | 2022150372 A1 | 7/2022 | | | |
| WO | 2022204574 A1 | 9/2022 | | | |
| WO | 2023279118 A2 | 1/2023 | | | |
| WO | 2023288304 A2 | 1/2023 | | | |
| WO | 2023034959 A2 | 3/2023 | | | |
| WO | 2023047338 A1 | 3/2023 | | | |
| WO | 2023049299 A2 | 3/2023 | | | |
| WO | 2023125814 A1 | 7/2023 | | | |
| WO | 2023155901 A1 | 8/2023 | | | |

(56)         References Cited

FOREIGN PATENT DOCUMENTS

| WO | 2023193536 A1 | 10/2023 |
| WO | 2023227669 A2 | 11/2023 |
| WO | 2023247753 A1 | 12/2023 |
| WO | 2023248110 A1 | 12/2023 |
| WO | 2024040083 A1 | 2/2024 |
| WO | 2024063273 A1 | 3/2024 |
| WO | 2024073385 A2 | 6/2024 |
| WO | 2024179426 A2 | 9/2024 |
| WO | 2024226156 A1 | 10/2024 |
| WO | 2024227047 A2 | 10/2024 |
| WO | 2024259364 A2 | 12/2024 |

OTHER PUBLICATIONS

Conticello, The AID/APOBEC family of nucleic acid mutators. Genome Biology (2008), 9:229. (Year: 2008).*

Wang et al., BE-PIGS: a base-editing tool with deaminases inlaid into Cas9 PI domain significantly expanded the editing scope. Signal Transduction and Targeted Therapy (2019) 4:36 (Year: 2019).*

Burstein et al., "New CRISPR-Cas systems from uncultivated microbes," Nature, Feb. 9, 2017, vol. 542, Article No. 7640, pp. 237-241 and pp. 242-264 containing Methods, Extended Data, and Figures (28 total pages).

Cheng et al., "Cloning, expression and activity identification of human innate immune protein apolipoprotein B mRNA editing enzyme catalytic subunit 3A (APOBEC3A)," Chinese Journal of Cellular and Molecular Immunology, 2017, vol. 33, No. 2, pp. 179-184 [English Abstract].

Ekstrand et al., "Frequent alterations of the PI3K/AKT/mTOR pathways in hereditary nonpolyposis colorectal cancer," Familial Cancer, 2010, vol. 9, pp. 125-129.

Kaya et al., "A bacterial Argonaute with noncanonical guide RNA specificity," Proceedings of the National Academy of Sciences of the United States of America, Apr. 12, 2016, vol. 113, No. 15, pp. 4057-4062.

Komor et al., "CRISPR-Based Technologies for the Manipulation of Eukaryotic Genomes," Cell, Jan. 12, 2017, vol. 168, pp. 20-36.

Kury et al., "De Novo Disruption of the Proteasome Regulatory Subunit PSMD12 Causes a Syndromic Neurodevelopmental Disorder," The American Journal of Human Genetics, Feb. 2, 2017, vol. 100, pp. 352-363.

Lavergne et al., "Defects in type IIA von Willebrand disease: a cysteine 509 to arginine substitution in the mature von Willebrand factor disrupts a disulphide loop involved in the interaction with platelet glycoprotein Ib-IX," British Journal of Haematology, 1992, vol. 82, pp. 66-72.

Liu et al., "Research Progress of Base Editing System," World Sci-Tech R&D, Dec. 2017, vol. 39, No. 6, pp. 457-462 [English Abstract].

Micozzi et al., "Human cytidine deaminase: A biochemical characterization of its naturally occurring variants," International Journal of Biological Macromolecules, Feb. 2014, vol. 63, pp. 64-74 and pp. 75-91 containing Acknowledgments, Abbreviations, References, and Figures (28 total pages).

Plosky, Brian S., "CRISPR-Mediated Base Editing without DNA Double-Strand Breaks," Molecular Cell, May 19, 2016, vol. 62, pp. 477-478.

Ramakrishna et al., "Gene disruption by cell-penetrating peptide-mediated delivery of Cas9 protein and guide RNA," Genome Research, 2014, vol. 24, pp. 1020-1027.

Ribeiro et al., "Protein Engineering Strategies to Expand CRISPR-Cas9 Applications," Hindawi: International Journal of Genomics, 2018, vol. 2018, No. 1652567, pp. 1-12.

Tsai et al., "GUIDE-seq enables genome-wide profiling of off-target cleavage by CRISPR-Cas nucleases," Nature Biotechnology, Feb. 2015, vol. 33, No. 2, pp. 187-197.

UniProt Accession No. P01011, Create Date Jul. 21, 1986.

UniProt Accession No. Q99ZW2, Create Date Jul. 11, 2012.

UniProt Proteome ID No. UP000009215, Create Date May 2012.

Wacey et al., "Disentangling the perturbational effects of amino acid substitutions in the DNA-binding domain of p53," Human Genetics, 1999, vol. 104, pp. 15-22.

Walton et al., "Unconstrained genome targeting with near-PAMless engineered CRISPR-Cas9 variants," Science, Mar. 26, 2020, pp. 1-11.

Wang et al., "Enhanced base editing by co-expression of free uracil DNA glycosylase inhibitor," Cell research, Oct. 2017, vol. 27, No. 10, pp. 1289-1292.

Wang et al., "Eliminating base-editor-induced genome-wide and transcriptome-wide off-target mutations," Nature Cell Biology, 2021, pp. 1-32.

Wijesinghe et al., "Efficient deamination of 5-methylcytosines in DNA by human APOBEC3A, but not by AID or APOBEC3G," Nucleic Acids Research, Jul. 13, 2012, vol. 40, No. 18, pp. 9206-9217.

Wolf et al., "tadA, an essential tRNA-specific adenosine deaminase from *Escherichia coli*," The EMBO Journal, 2002, vol. 21, No. 14, pp. 3841-3851.

Yan et al., "Functionally diverse type V CRISPR-Cas systems," Science, Jan. 4, 2019, vol. 363, pp. 88-91.

Yang et al., "Engineering and optimising deaminase fusions for genome editing," Nature Communications, 2016, vol. 7, No. 13330, pp. 1-11.

Yang et al., "Increasing targeting scope of adenosine base editors in mouse and rat embryos through fusion of TadA deaminase with Cas9 variants," Protein & Cell, 2018, vol. 9, No. 9, pp. 814-819.

Yang et al., "PAM-Dependent Target DNA Recognition and Cleavage by C2c1 CRISPR-Cas Endonuclease," Cell, Dec. 15, 2016, vol. 167, pp. 1814-1828.

Yeh et al., "In vivo base editing of post-mitotic sensory cells," Nature Communications, 2018, vol. 9, No. 2184, pp. 1-10.

Yu et al., "Cytosine base editors with minimized unguided DNA and RNA off-target events and high on-target activity," Nature Communications, 2020, vol. 11, No. 2052, pp. 1-10.

Zafra et al., "Optimized base editors enable efficient editing in cells, organoids and mice," Nature Biotechnology, 2018, pp. 1-6.

Zheng et al., "DNA Editing in DNA/RNA Hybrids by Adenosine Deaminases That Act on RNA," Nucleic Acids Research, 2017, vol. 45, No. 6, pp. 3369-3377.

Zhou et al., "Atypical behaviour and connectivity in SHANK3-mutant macaques," Nature, Jun. 20, 2019, vol. 570, pp. 326-331.

Zhou et al., "Off-target RNA mutation induced by DNA base editing and its elimination by mutagenesis," Nature, Jul. 11, 2019, vol. 571, pp. 275-277.

Zuo et al., "Cytosine base editor generates substantial off-target singlenucleotide variants in mouse embryos," Science, vol. Apr. 19, 2019, vol. 364, No. 6437, pp. 289-292.

Zuris et al., "Efficient Delivery of Genome-Editing Proteins In Vitro and In Vivo," Nature Biotechnology, Jan. 2015, vol. 33, No. 1, pp. 73-80.

Cartegni et al., "Determinants of Exon 7 Splicing in the Spinal Muscular Atrophy Genes, SMN1 and SMN2," The American Journal of Human Genetics, Jan. 2006, vol. 78, pp. 63-77.

Chang et al., "Degradation of survival motor neuron (SMN) protein is mediated via the ubiquitin/proteasome pathway," Neurochemistry International, 2004, vol. 45, pp. 1107-1112.

Cho et al., "A degron created by SMN2 exon 7 skipping is a principal contributor to spinal muscular atrophy severity," Genes & Development, 2010, vol. 24, pp. 438-442.

Corcia et al., "The importance of the SMN genes in the genetics of sporadic ALS," Amyotrophic Lateral Sclerosis, 2009, vol. 10, pp. 436-440.

Corti et al., "Genetic Correction of Human Induced Pluripotent Stem Cells from Patients with Spinal Muscular Atrophy," Science Translational Medicine, Dec. 19, 2012, vol. 4, Article No. 165, pp. 1-20 and pp. 21-32 containing Figures (32 total pages).

Cucchiarini et al., "Enhanced expression of the central survival of motor neuron (SMN) protein during the pathogenesis of osteoarthritis," Journal of Cellular and Molecular Medicine, 2014, vol. 18, No. 1, pp. 115-124.

(56) References Cited

OTHER PUBLICATIONS

Doudna, Jennifer A., "The Promise and Challenge of Therapeutic Genome Editing," Nature, Feb. 2020, vol. 578, Article No. 7794, pp. 229-236 and pp. 20-24 containing Figures (24 total pages).

D'Ydewalle et al., "The Antisense Transcript SMN-AS1 Regulates SMN Expression and Is a Novel Therapeutic Target for Spinal Muscular Atrophy," Neuron, Jan. 4, 2017, vol. 93, pp. 63-79.

Fagagna et al., "The Gam protein of bacteriophage Mu is an orthologue of eukaryotic Ku," Embo reports, 2003, vol. 4, No. 1, pp. 47-52.

GenBank Accession No. AIT42264.1, downloaded Jan. 9, 2024.

GenBank Accession No. AKA60242.1, downloaded Jan. 9, 2024.

GenBank Accession No. AKQ21048.1, downloaded Jan. 9, 2024.

GenBank Accession No. AKS40380.1, downloaded Jan. 9, 2024.

GenBank Protein No. 4UN5_B, downloaded Jan. 9, 2024.

Hendel et al., "Chemically modified guide RNAs enhance CRISPR-Cas genome editing in human primary cells," Nature Biotechnology, Sep. 2015, vol. 33, Article No. 9, pp. 985-989 and pp. 13-14 containing Figures (14 total pages).

Kim et al., "Increasing the genome-targeting scope and precision of base editing with engineered Cas9-cytidine deaminase fusions," Nature Biotechnology, Apr. 2017, vol. 35, Article No. 4, pp. 371-376 and pp. 377-385 containing Online Methods, Supplementary Material, Acknowledgments, References and Figures (15 total pages).

Le et al., "SMND7, the major product of the centromeric survival motor neuron (SMN2 ) gene, extends survival in mice with spinal muscular atrophy and associates with full-length SMN," Human Molecular Genetics, 2005, vol. 14, No. 6, pp. 845-857.

Lefebvre et al., "Identification and Characterization of a Spinal Muscular Atrophy-Determining Gene," Jan. 13, 1995, vol. 80, pp. 155-165.

Lin et al., "[Construction and evaluation of DnaB split intein high expression vector and a six amino acids cyclic peptide library]," Chinese Journal of Biotechnology, Nov. 1, 2008, vol. 24, No. 11, pp. 1924-1930 [English Abstract Only].

Lorson et al., "A single nucleotide in the SMN gene regulates splicing and is responsible for spinal muscular atrophy," Proceedings of the National Academy of Sciences of the United States of America, May 1999, vol. 96, pp. 6307-6311.

Lutz et al., "Postsymptomatic restoration of SMN rescues the disease phenotype in a mouse model of severe spinal muscular atrophy," The Journal of Clinical Investigation, Aug. 2011, vol. 121, No. 8, pp. 3029-3041.

Monani et al., "A single nucleotide difference that alters splicing patterns distinguishes the SMA gene SMN1 from the copy gene SMN2," Human Molecular Genetics, 1999, vol. 8, No. 7, pp. 1177-1183.

Murray et al., "Selective vulnerability of motor neurons and dissociation of pre- and post-synaptic pathology at the neuromuscular junction in mouse models of spinal muscular atrophy," Human Molecular Genetics, 2008, vol. 17, No. 7, pp. 949-962.

NCBI Reference Sequence No. NC_000001.11, downloaded Jan. 9, 2024.

NCBI Reference Sequence No. WP_002989955.1, downloaded Jan. 9, 2024.

NCBI Reference Sequence No. WP_010922251.1, downloaded Jan. 9, 2024.

NCBI Reference Sequence No. WP_011054416.1, downloaded Jan. 9, 2024.

NCBI Reference Sequence No. WP_011284745.1, downloaded Jan. 9, 2024.

NCBI Reference Sequence No. WP_011285506.1, downloaded Jan. 9, 2024.

NCBI Reference Sequence No. WP_011527619.1, downloaded Jan. 9, 2024.

NCBI Reference Sequence No. WP_012560673.1, downloaded Jan. 9, 2024.

NCBI Reference Sequence No. WP_014407541.1, downloaded Jan. 9, 2024.

NCBI Reference Sequence No. WP_020905136.1, downloaded Jan. 9, 2024.

NCBI Reference Sequence No. WP_023080005.1, downloaded Jan. 9, 2024.

NCBI Reference Sequence No. WP_023610282.1, downloaded Jan. 9, 2024.

NCBI Reference Sequence No. WP_030125963.1, downloaded Jan. 9, 2024.

NCBI Reference Sequence No. WP_030126706.1, downloaded Jan. 9, 2024.

NCBI Reference Sequence No. WP_031488318.1, downloaded Jan. 9, 2024.

NCBI Reference Sequence No. WP_032460140.1, downloaded Jan. 9, 2024.

NCBI Reference Sequence No. WP_032461047.1, downloaded Jan. 9, 2024.

NCBI Reference Sequence No. WP_032462016.1, downloaded Jan. 9, 2024.

NCBI Reference Sequence No. WP_032462936.1, downloaded Jan. 9, 2024.

NCBI Reference Sequence No. WP_032464890.1, downloaded Jan. 9, 2024.

NCBI Reference Sequence No. WP_038431314.1, downloaded Jan. 9, 2024.

NCBI Reference Sequence No. WP_038432938.1, downloaded Jan. 9, 2024.

NCBI Reference Sequence No. WP_038434062.1, downloaded Jan. 9, 2024.

NCBI Reference Sequence No. WP_048327215.1, downloaded Jan. 9, 2024.

NCBI Reference Sequence No. WP_049519324.1, downloaded Jan. 9, 2024.

Nelson et al., "In vivo genome editing improves muscle function in a mouse model of Duchenne muscular dystrophy," Science, Jan. 22, 2016, vol. 351, No., 6271, pp. 403-407.

Ousterout et al., "Multiplex CRISPR/Cas9-based genome editing for correction of dystrophin mutations that cause Duchenne muscular dystrophy," Nature Communications, vol. 6, No. 6244, pp. 1-13, year: 2015.

Extended European Search Report dated Nov. 11, 2022 in corresponding European Patent Application No. 20748889.1 (7 pages).

Kim et al., "Structural and Kinetic Characterization of *Escherichia coli* TadA, the Wobble-Specific TRNA Deaminase," Biochemistry, 2006, vol. 45, No. 20, pp. 6407-6416.

Kitamura et al., "Uracil DNA Glycosylase Counteracts APOBEC3G-Induced Hypermutation of Hepatitis B Viral Genomes: Excision Repair of Covalently Closed Circular DNA," Plos Pathogens, May 2013, vol. 9, No. 5, e1003361, pp. 1-14.

Kleinstiver et al., "Broadening *Staphylococcus aureus* Cas9 Targeting Range by Modifying PAM Recognition," Nature Biotechnology, Dec. 2015, vol. 33, No. 12, pp. 1293-1298.

Kleinstiver et al., "Engineered CRISPR-Cas9 nucleases with altered PAM specificities," Nature, Jul. 23, 2015, vol. 523, pp. 481-485.

Kleinstiver et al., "High-fidelity CRISPR-Cas9 variants with undetectable genome-wide off-targets," Molecular Therapy, Jan. 28, 2016, vol. 529, No. 75187, pp. 490-495.

Koblan et al., "Improving cytidine and adenine base editors by expression optimization and ancestral reconstruction," Nature Biotechnology, 2018, pp. 1-4.

Komor et al., "Improved base excision repair inhibition and bacteriophage Mu Gam protein yields C:G-to-T:A base editors with higher efficiency and product purity," Science Advances, Aug. 30, 2017, vol. 3, No. eaao4774, pp. 1-9.

Komor et al., "Programmable editing of a target base in genomic DNA without double-stranded DNA cleavage," Nature, May 19, 2016, vol. 533, pp. 420-424.

Kundu et al., "Leucine to proline substitution by SNP at position 197 in Caspase-9 gene expression leads to neuroblastoma: a bioinformatics analysis," 3 Biotech, 2013, vol. 3, pp. 225-234.

Lapinaite et al., "DNA capture by a CRISPR-Cas9-guided adenine base editor," Science, Jul. 31, 2020, vol. 369, No. 6503, pp. 566-571.

(56)           References Cited

OTHER PUBLICATIONS

Lau et al., "Molecular basis for discriminating between normal and damaged bases by the human alkyladenine glycosylase, AAG," Proceedings of the National Academy of Sciences of the United States of America, Dec. 5, 2000, vol. 97, No. 25, pp. 13573-13578.

Lazar et al., "Transforming Growth Factor α: Mutation of Aspartic Acid 47 and Leucine 48 Results in Different Biological Activities," Molecular and Cellular Biology, Mar. 1988, vol. 8, No. 3, pp. 1247-1252.

Lee et al., "CRISPR-Pass: Gene Rescue of Nonsense Mutations Using Adenine Base Editors," Molecular Therapy, Aug. 2019, vol. 27, No. 8, pp. 1364-1371.

Lee et al., "Cytosine but not adenine base editor generates mutations in mice," bioRxiv, 2019, pp. 1-24.

Lee et al., "PIK3CA gene is frequently mutated in breast carcinomas and hepatocellular carcinomas," Oncogene, 2005, vol. 24, pp. 1477-1480.

Lenk et al., "Pathogenic Mechanism of the FIG4 Mutation Responsible for Charcot-Marie-Tooth Disease CMT4J," PLoS Genetics, Jun. 2011, vol. 7, No. 6, e1002104, pp. 1-13.

Li et al., "Current Approaches for Engineering Proteins with Diverse Biological Properties," Bio-Applications of Nanoparticles, 2007, pp. 1-16.

Liu et al., "C2c1-sgRNA Complex Structure Reveals RNA-Guided DNA Cleavage Mechanism," Molecular Cell, Jan. 19, 2017, vol. 65, pp. 310-322.

Lyons et al., "Efficient Recognition of an Unpaired Lesion by a DNA Repair Glycosylase," Journal of the American Chemical Society, 2009, vol. 131, No. 49, p. 17742-17743.

Ma et al., "Targeted AID-mediated mutagenesis (TAM) enables efficient genomic diversification in mammalian cells," Nature Methods, Dec. 2016, vol. 13, No. 12, pp. 1029-1035.

Makarova et al., "Classification and Nomenclature of CRISPR-Cas Systems: Where from Here?," The CRISPR Journal, 2018, vol. 1, No. 5, pp. 325-336.

Mali et al., "Cas9 as a versatile tool for engineering biology," Nature Methods, Oct. 2013, vol. 10, No. 10, pp. 957-963.

Mali et al., "CAS9 transcriptional activators for target specificity screening and paired nickases for cooperative genome engineering," Nature Biotechnology, 2013, pp. 1-6.

Mccann et al., "MagnEdit—interacting factors that recruit DNA-editing enzymes to single base targets," Life Science Alliance, 2020, vol. 3, No. 4, e201900606, pp. 1-9.

Mikami et al., "Comparison of CRISPR/Cas9 expression constructs for efficient targeted mutagenesis in rice," Plant Molecular Biology, 2015, vol. 88, pp. 561-572.

Miller et al., "Continuous evolution of SpCas9 variants compatible with non-G PAMs," Nature Biotechnology, Apr. 2020, vol. 38, No. 4, pp. 471-481.

Mohamad et al., "Human hemoglobin G-Makassar variant masquerading as sickle cell anemia," Hematology Reports, 2018, vol. 10, No. 7210, pp. 92-95.

Mullins et al., "Transgenesis in Nonmurine Species," Hypertension, Oct. 1993, vol. 22, No. 4, pp. 630-633.

Navaratnam et al., "An Overview of Cytidine Deaminases," International Journal of Hematology, 2006, vol. 83, pp. 195-200.

Nishida et al., "Targeted nucleotide editing using hybrid prokaryotic and vertebrate adaptive immune systems," Science, Sep. 16, 2016, vol. 353, No. 6305, pp. 1248-aaf8729-8.

Nishimasu et al., "Engineered CRISPR-Cas9 nuclease with expanded targeting space," Science, 2018, vol. 361, pp. 1259-1262.

Okumura et al., "Evolutionary paths of streptococcal and staphylococcal superantigens," BMC Genomics, 2012, vol. 13, No. 404, pp. 1-16.

Parr et al., "N1-Methylpseudouridine substitution enhances the performance of synthetic mRNA switches in cells," Nucleic Acids Research, 2020, vol. 48, No. 6, e35, pp. 1-9.

Pausch et al., "CRISPR-CasΦ from huge phages is a hypercompact genome editor," Science, Jul. 17, 2020, vol. 369, No. 6501, pp. 333-337.

Phillips, Anthony J., "The challenge of gene therapy and DNA delivery," Journal of Pharmacy and Pharmacology, 2001, vol. 53, pp. 1169-1174.

Poller et al., "A Leucine-to-Proline Substitution Causes a Defective α1-Antichymotrypsin Allele Associated with Familial Obstructive Lung Disease," Genomics, 1993, vol. 17, pp. 740-743.

Putnam et al., "Protein Mimicry of DNA from Crystal Structures of the Uracil-DNA Glycosylase Inhibitor Protein and its Complex with *Escherichia coli* Uracil-DNA Glycosylase," Journal of Molecular Biology, 1999, vol. 287, pp. 331-346.

Qi et al., "Repurposing CRISPR as an RNA-Guided Platform for Sequence-Specific Control of Gene Expression," Cell, Feb. 28, 2013, vol. 152, pp. 1173-1183.

Ran et al., "In vivo genome editing using *Staphylococcus aureus* Cas9," Nature, Apr. 9, 2015, vol. 520, No. 7546, pp. 186-191.

Rees et al., "Analysis and minimization of cellular RNA editing by DNA adenine base editors," Science Advances, May 8, 2019, vol. 5, No. eaax5717, pp. 1-10.

Rees et al., "Base editing: precision chemistry on the genome and transcriptome of living cells," Nature Reviews Genetics, Dec. 2018, vol. 19, No. 12, pp. 770-788.

Rees et al., "Improving the DNA specificity and applicability of base editing through protein engineering and protein delivery," Nature Communications, 2017, vol. 8, No. 15790, pp. 1-10.

Richter et al., "Phage-assisted evolution of an adenine base editor with improved Cas domain compatibility and activity," Nature Biotechnology, Jul. 2020, vol. 38, No. 7, pp. 883-891.

Sang, Helen, "Prospects for transgenesis in the chick," Mechanisms of Development, 2004, vol. 121, pp. 1179-1186.

Shimomura et al., "Complete genome sequencing and analysis of a Lancefield group G *Streptococcus dysgalactiae* subsp. equisimilis strain causing streptococcal toxic shock syndrome (STSS)," BMC Genomics, 2011, vol. 12, No. 17, pp. 1-17.

Shmakov et al., "Discovery and Functional Characterization of Diverse Class 2 CRISPR-Cas Systems," Molecular Cell, Nov. 5, 2015, vol. 60, pp. 385-397.

Slaymaker et al., "Rationally engineered Cas9 nucleases with improved specificity," Science, Jan. 1, 2016, vol. 351, No. 6268, pp. 84-88.

Tan et al., "Engineering of high-precision base editors for site-specific single nucleotide replacement," Nature Communications, 2019, vol. 10, No. 439, pp. 1-10.

Tanenbaum et al., "A Protein-Tagging System for Signal Amplification in Gene Expression and Fluorescence Imaging," Cell, Oct. 23, 2014, vol. 159, pp. 635-646.

Teng et al., "Mutational analysis of apolipoprotein B mRNA editing enzyme (APOBEC1): structure-function relationships of RNA editing and dimerization," Journal of Lipid Research, 1999, vol. 40, pp. 623-635.

Sang et al., "A unique uracil-DNA binding protein of the uracil DNA glycosylase superfamily," Nucleic Acids Research, Sep. 30, 2015, vol. 43, No. 17, pp. 8452-8463.

Schrank et al., "Inactivation of the survival motor neuron gene, a candidate gene for human spinal muscular atrophy, leads to massive cell death in early mouse embryos," Proceedings of the National Academy of Sciences of the United States of America, Sep. 1997, vol. 94, pp. 9920-9925.

Shee et al., "Engineered proteins detect spontaneous DNA breakage in human and bacterial cells," eLife, 2013, vol. 2, No. e01222, pp. 1-25.

Singh et al., "Splicing of a Critical Exon of Human Survival Motor Neuron Is Regulated by a Unique Silencer Element Located in the Last Intron," Molecular and Cellular Biology, Feb. 2006, vol. 26, No. 4, pp. 1333-1346.

Talbot et al., "Spinal muscular atrophy," Journal of Inherited Metabolic Disease, Jun. 2001, vol. 21, No. 2, pp. 189-197 [Abstract Only].

UniProt Accession No. P51908, Downloaded Jan. 9, 2024.

Wirth et al., "Mildly affected patients with spinal muscular atrophy are partially protected by an increased SMN2 copy number," Human Genetics, 2006, vol. 119, pp. 422-428.

Yang et al., "APOBEC: From mutator to editor," Journal of Genetics and Genomics, 2017, vol. 44, pp. 423-437.

(56) References Cited

OTHER PUBLICATIONS

Zong et al., "Precise base editing in rice, wheat and maize with a Cas9-cytidine deaminase fusion," Nature Biotechnology, 2017, pp. 1-4.

Addgene Plasmid No. 44246, Create Date Feb. 28, 2013.

Addgene Plasmid No. 73021, Create Date Apr. 20, 2016.

Addgene Plasmid No. 79620, Create Date Aug. 4, 2016.

Alexandrov et al., "Signatures of mutational processes in human cancer," Nature, Aug. 22, 2013, vol. 500, pp. 415-421.

Andries et al., "N1-methylpseudouridine-incorporated mRNA outperforms pseudouridine-incorporated mRNA by providing enhanced protein expression and reduced immunogenicity in mammalian cell lines and mice," Journal of Controlled Release, 2015, vol. 217, pp. 337-344.

Bae et al., "Cas-OFFinder: a fast and versatile algorithm that searches for potential off-target sites of Cas9 RNA-guided endonucleases," Bioinformatics, Jan. 24, 2014, vol. 30, No. 10, pp. 1473-1475.

Billon et al., "CRISPR-Mediated Base Editing Enables Efficient Disruption of Eukaryotic Genes through Induction of STOP Codons," Molecular Cell, Sep. 21, 2017, vol. 67, pp. 1068-1079.

Branden and Tooze, "The Building Blocks," Introduction to Protein Structure, 1999, vol. 2, pp. 3-12.

Briner et al., "Guide RNA Functional Modules Direct Cas9 Activity and Orthogonality," Molecular Cell, Oct. 23, 2014, vol. 56, pp. 333-339.

Bulow et al., "Multienzyme systems obtained by gene fusion," Trends in Biotechnology, Jan. 1991, vol. 9, pp. 226-231.

Cameron, Ewan R., "Recent Advances in Transgenic Technology," Molecular Biotechnology, 1997, vol. 7, pp. 253-265.

Chatterjee et al., "A Cas9 with PAM recognition for adenine dinucleotides," Nature Communications, 2020, vol. 11, No. 2474, pp. 1-6.

Chester et al., "The apolipoprotein B mRNA editing complex performs a multifunctional cycle and suppresses nonsense-mediated decay," The EMBO Journal, 2003, vol. 22, No. 15, pp. 3971-3982.

Chichili et al., "Linkers in the structural biology of protein-protein interactions," Protein Science, 2013, vol. 22, pp. 153-167.

Chylinski et al., "The tracrRNA and Cas9 families of type II CRISPR-Cas immunity systems," RNA Biology, May 2013, vol. 10, No. 5, pp. 726-737.

Collantes et al., "Development and Characterization of a Modular CRISPR and RNA Aptamer Mediated Base Editing System," The CRISPR Journal, 2021, vol. 4, No. 1, pp. 58-68.

Cong et al., "Multiplex Genome Engineering Using CRISPR/Cas Systems," Science, Feb. 15, 2013, vol. 339, No. 6121, pp. 819-823.

Deltcheva et al., "CRISPR RNA maturation by trans-encoded small RNA and host factor RNase III," Nature, Mar. 31, 2011, vol. 471, pp. 602-607.

Endo et al., "Toward establishing an efficient and versatile gene targeting system in higher plants," Biocatalysis and Agricultural Biotechnology, 2014, vol. 3, pp. 2-6.

Ferretti et al., "Complete genome sequence of an M1 strain of *Streptococcus pyogenes*," Proceedings of the National Academy of Sciences of the United States of America, Apr. 10, 2001, vol. 98, No. 8, pp. 4658-4663.

Fonfara et al., "Phylogeny of Cas9 determines functional exchangeability of dual-RNA and Cas9 among orthologous type II CRISPR-Cas systems," Nucleic Acids Research, 2014, vol. 42, No. 4, pp. 2577-2590.

Freshney et al., "Culture of Animal Cells, A Manual of Basic Technique," Food and Chemical Toxicology, 1983, vol. 23, No. 3, pp. 403-404.

Fu et al., "Human cell based directed evolution of adenine base editors with improved efficiency," Nature Communications, 2021, vol. 12, No. 5897, pp. 1-11.

Gardlik et al., "Vectors and delivery systems in gene therapy," Medical Science Monitor, 2005, vol. 11, No. 4, pp. RA110-RA121.

Gasiunas et al., "Cas9-crRNA ribonucleoprotein complex mediates specific DNA cleavage for adaptive immunity in bacteria," Proceedings of the National Academy of Sciences of the United States of America, Sep. 4, 2012, pp. E2579-E2586.

Gasiunas et al., "RNA-dependent DNA endonuclease Cas9 of the CRISPR system: Holy Grail of genome editing?" Trends in Microbiology, Nov. 2013, vol. 21, No. 11, pp. 562-567.

Gaudelli et al., "Directed evolution of adenine base editors with increased activity and therapeutic application," Nature Biotechnology, 2020, pp. 1-15.

Gaudelli et al., "Programmable base editing of A•T to G•C in genomic DNA without DNA cleavage," Nature, Nov. 23, 2017, vol. 551, pp. 464-471.

Grunewald et al., "CRISPR DNA base editors with reduced RNA off-target and self-editing activities," Nature Biotechnology, Sep. 2019, vol. 37, No. 9, pp. 1041-1048.

Grunewald et al., "Transcriptome-wide off-target RNA editing induced by CRISPR-guided DNA base editors," Nature, May 2019, vol. 569, No. 7756, pp. 433-437.

Guilinger et al., "Fusion of catalytically inactive Cas9 to FokI nuclease improves the specificity of genome modification," Nature Biotechnology, 2014, pp. 1-6.

Guo et al., "Protein tolerance to random amino acid change," Proceedings of the National Academy of Sciences of the United States of America, Jun. 22, 2004, vol. 101, No. 25, pp. 9205-9210.

Hill et al., "Functional Analysis of Conserved Histidines in ADP-Glucose Pyrophosphorylase from *Escherichia coli*," Biochemical Biophysical Research Communications, 1998, vol. 244, No. 2, pp. 573-577.

Houdebine, Louis-Marie, "The methods to generate transgenic animals and to control transgene expression," Journal of Biotechnology, 2002, vol. 98, pp. 145-160.

Hu et al., "Evolved Cas9 variants with broad PAM compatibility and high DNA specificity," Nature, Apr. 5, 2018, vol. 556, pp. 57-63.

Hua et al., "Expanding the base editing scope in rice by using Cas9 variants," Plant Biotechnology Journal, 2019, vol. 17, pp. 499-504.

Huang et al., "Circularly permuted and PAM-modified Cas9 variants broaden the targeting scope of base editors," Nature Biotechnology, Jun. 2019, vol. 37, No. 6, pp. 626-631.

Huang et al., "DNA epigenome editing using CRISPR-Cas SunTag-directed DNMT3A," Genome Biology, 2017, vol. 18, No. 176, pp. 1-11.

Jeong et al., "Adenine base editor engineering reduces editing of bystander cytosines," Nature Biotechnology, 2021, pp. 1-12.

Jeong et al., "Precise adenine base editors that exhibit minimized cytosine catalysis," Research Square, 2020, pp. 1-15.

Jiang et al., "Chemical modifications of adenine base editor mRNA and guide RNA expand its application scope," Nature Communications, 2020, vol. 11, No. 1979, pp. 1-9.

Jin et al., "Cytosine, but not adenine, base editors induce genome-wide off-target mutations in rice," Science, Apr. 19, 2019, vol. 364, pp. 292-295.

Jinek et al., "A Programmable Dual-RNA-Guided DNA Endonuclease in Adaptive Bacterial Immunity," Science, Aug. 17, 2012, vol. 337, No. 6096, pp. 816-821.

Jinek et al., "RNA-programmed genome editing in human cells," eLife, 2013, vol. 2, No. e00471, pp. 1-9.

Jore et al., "Structural basis for CRISPR RNA-guided DNA recognition by Cascade," Nature Structural & Molecular Biology, May 2011, vol. 18, No. 5, pp. 529-537.

Kappel et al., "Regulating gene expression in transgenic animals," Current Opinion in Biotechnology, 1992, vol. 3, pp. 548-553.

Kim et al., "Adenine base editors catalyze cytosine conversions in human cells," Nature Biotechnology, Oct. 2019, vol. 37, pp. 1145-1148.

Kim et al., "Highly efficient RNA-guided genome editing in human cells via delivery of purified Cas9 ribonucleoproteins," Genome Research, 2014, vol. 24, pp. 1012-1019.

Kim et al., "Rescue of high-specificity Cas9 variants using sgRNAs with matched 5' nucleotides," Genome Biology, 2017, vol. 18, No. 218, pp. 1-6.

Kim et al., "Transcriptional Repression by Zinc Finger Peptides," The Journal of Biological Chemistry, Nov. 21, 1997, vol. 272, No. 47, p. 29795-29800.

(56)         References Cited

OTHER PUBLICATIONS

International Search Report and Written Opinion in International Patent Application No. PCT/US2020/016285, mailed May 4, 2020 (12 pages).

Baños-Sanz et al., "Crystal structure and functional insights into uracil-DNA glycosylase inhibition by phage φ29 DNA mimic protein p56," Nucleic Acids Research, 2013, vol. 41, No. 13, pp. 6761-6773.

Charpentier et al. "Rewriting a genome", Nature, Mar. 2013, vol. 495, No. 7439, pp. 50-51.

Chen et al. "Targeting genomic rearrangements in tumor cells through Cas9-mediated insertion of a suicide gene." Nature Biotechnology, Jun. 2017, vol. 35, No. 6, pp. 543-552.

De Souza. "Primer: genome editing with engineered nucleases." Nature Methods, vol. 9, No. 1, Jan. 2012, pp. 27-27.

Grimm et al., In vitro and In vivo Gene Therapy Vector Evolution via Multispecies Interbreeding and Retargeting of Adeno-Associated Viruses. J. Virol., 2008, vol. 82, p. 5887-5911.

Kim et al., "Highly efficient RNA-guided base editing in mouse embryos," Nature Biotechnology, 2017, pp. 1-4.

Kleinstiver et al., "Engineered CRISPR-Cas9 nucleases with altered PAM specificities," Nature, Jul. 23, 2015, vol. 523, Article No. 7561, pp. 481-485 and pp. 24-27 containing Figures (27 total pages).

Li et al. "Base editing with a Cpf1-cytidine deaminase fusion." Nature biotechnology, 2018, vol. 36, No. 4, pp. 324-327.

Liu, et al. "Crossing the blood-brain barrier with AAV vectors," Metabolic Brain Disease, 2021, vol. 36, pp. 45-52.

Maeder et al. "CRISPR RNA-guided activation of endogenous human genes", Nature Methods, Oct. 2013, vol. 10, No. 10, pp. 977-979.

Mariani et al. "Species-specific exclusion of APOBEC3G from HIV-1 virions by Vif." Cell, 2003, vol. 114, No. 1, 21-31.

NCBI Reference Protein No. Q694B3.2, downloaded Apr. 8, 2024.

O'Connell et al., Programmable RNA recognition and cleavage by CRISPR/Cas9. Nature, 2014, vol. 516, p. 263-266.

Pattanayak et al., "High-throughput profiling of off-target DNA cleavage reveals RNA-programmed Cas9 nuclease specificity," Nature Biotechnology, Sep. 2013, vol. 31, No. 9, pp. 839-843.

Ranzau et al., "The wild-type tRNA adenosine deaminase enzyme TadA is capable of sequence-specific DNA base editing." Chembiochem, Aug. 2023, vol. 24, No. 16, pp. 1-35.

Riesenberg et al. "Improved gRNA secondary structures allow editing of target sites resistant to CRISPR-Cas9 cleavage." Nature communications, 2022, vol. 13 No. 1, pp. 489.

Rogozin et al. "Evolution and diversification of lamprey antigen receptors: evidence for involvement of an Aid-Apobec family cytosine deaminase," Nature Immunology, Jun. 2007, vol. 8, No. 6, pp. 647-656.

Ruffolo, et al., "Design of highly functional genome editors by modeling of the universe of CRISPR-Cas Sequences," bioRxiv, posted Apr. 22, 2024, doi: 10.1101/2024.04.22.590591.

Song et al. "Delivery of CRISPR/Cas systems for cancer gene therapy and immunotherapy." Advanced Drug Delivery Reviews, 2021, vol. 168, pp. 150-180.

Stanton et al. "Systemic administration of novel engineered AAV capsids facilitates enhanced transgene expression in the macaque CNS." Med, 2023, vol. 4. No. 1, pp. 31-50.

Thorpe et al. "Functional Correction of Episomal Mutations With Short DNA Fragments and RNA-DNA Oligonucleotides." Journal of Gene Medicine, Jan. 2002, vol. 4, No. 1, pp. 195-204.

Tipanee, et al. "Transposons: Moving Forward from Preclinical Studies to Clinical Trials," Human Gene Therapy, Nov. 2017, pp. 1087-1104.

Tsai et al. "Dimeric CRISPR RNA-guided FokI nucleases for highly specific genome editing." Nature Biotechnology, Apr. 2014, vol. 32, No. 6, pp. 569-576.

UniProt Accession No. Q6JC40, Downloaded Nov. 14, 2024.

Wan et al. "Material solutions for delivery of CRISPR/Cas-based genome editing tools: current status and future outlook." Materials Today, Jun. 2019, vol. 26, pp. 40-66.

Zhou et al., "Cas12a variants designed for lower genome-wide off-target effect through stringent PAM recognition", Molecular Therapy, Jan. 2022, vol. 30, No. 1 , pp. 1-12.

Burgess et al., "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue," The Journal of Cell Biology, Nov. 1990, vol. 111, pp. 2129-2138.

Cofsky et al., "CRISPR-Cas9 bends and twists DNA to read its sequence," Nat Struct Mol Biol, Apr. 2022, vol. 29, No. 4, pp. 395-402.

Lin et al. "Structure-function relations in glucagon. Properties of highly purified Des-his1-, monoiodo-, and [Des-Asn28, Thr29](homoserine lactone27)-glucagon." Biochemistry vol. 14, No. 8, 1975, pp. 1559-1563.

Ma et al., "A new mutation in BFSP2 (G1091A) causes autosomal dominant congenital lamellar cataracts," Molecular Vision, Oct. 2008, vol. 14, pp. 1906-1911.

Schwartz et al., "A superactive insulin: [B10-Aspartic acid]insulin(human)," Proc. Natl. Acad. Sci. USA, Sep. 1987, vol. 84, pp. 6408-6411.

* cited by examiner

Structural basis for bystander mutagenesis

"Danger Zone"

Any ssDNA within deamination zone is a potential spurious off-target.

TadA

32aa linker

Cas9

Possible Strategies

• Lock deaminase into preferred orientation.

• Inactivate deaminase until it is near desired mutation spot.

• Activate enzyme only when in proximity of ssDNA.

Prediction of BE target DNA 10 nucleotides (1-10) of unknown position 2 paths

DNA Pos1

DNA Pos2

Engineer preferred orientation

- Position deaminase in proximity to BE target DNA by insertion into Cas9
- Linker conformation TadA Pos1

TadA Pos2

Fluorescence assay for off-targets.

Comparison of ABE v. ABE system with TadA in Trans.

Potential substrates for spurious off-target base editing can be tested.
Test for good "spurious deamination" substrate in above assays
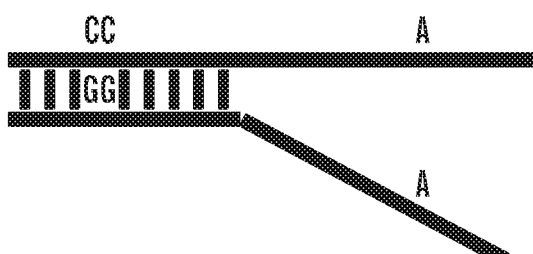
*FIG. 11*

Assay to evaluate the activities of deaminases in the *in cis - in trans* assay

Experimental design: evaluate base editing with various deaminases *in cis* (covalent, base editor context) vs. *in trans* (spurious deamination mimic)

C to T base editing *in trans* nCas9-UGI-UGI deaminase

C to T base editing *in cis* deaminase-nCas9-UGI-UGI

For ABEs, no UGIs were attached.

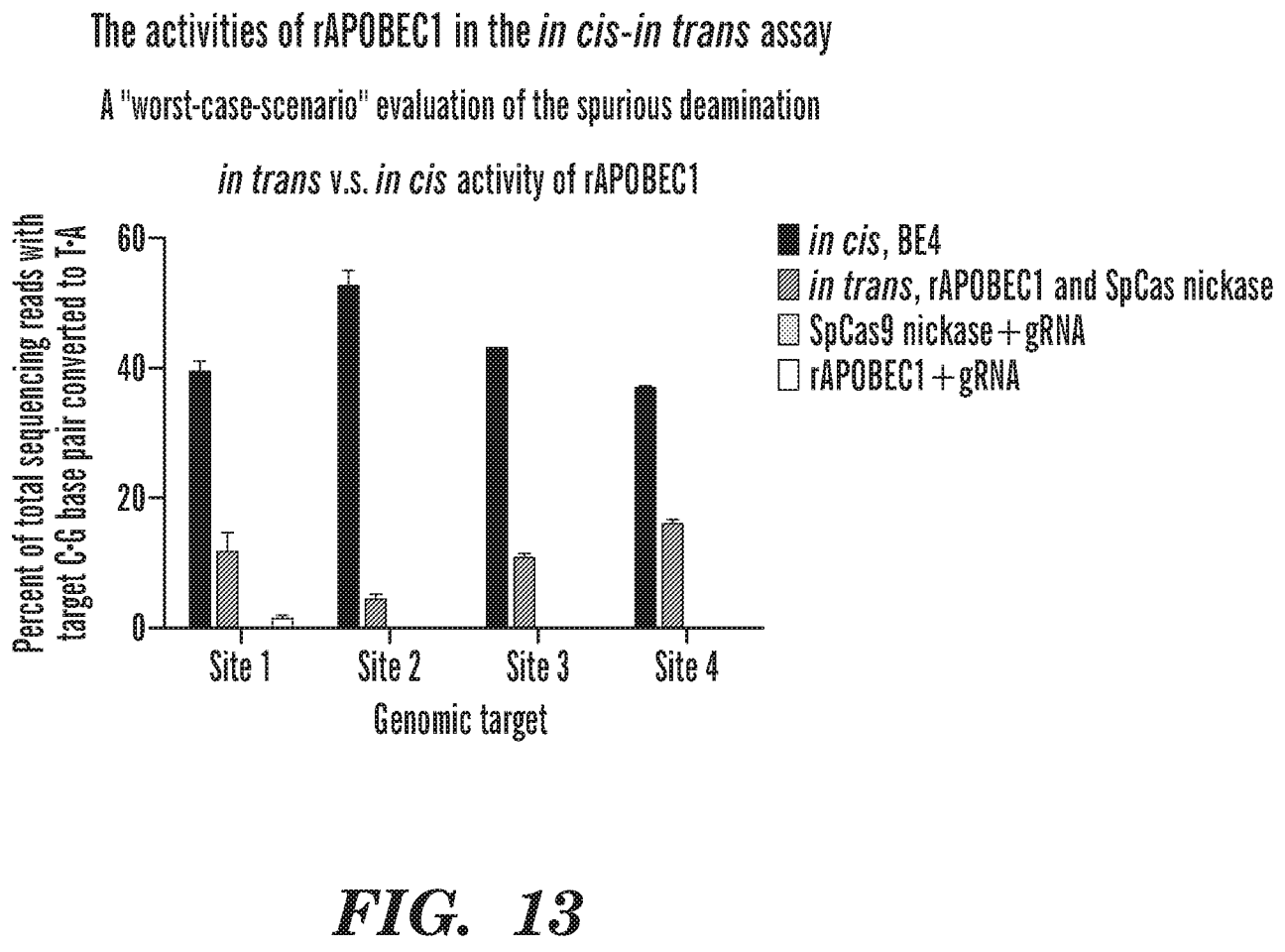

The activities of rAPOBEC1 in the *in cis–in trans* assay

A "worst-case-scenario" evaluation of the spurious deamination

Legend:
- in cis, BE4
- in trans, rAPOBEC1 and SpCas nickase
- SpCas9 nickase + gRNA
- rAPOBEC1 + gRNA

*in trans* v.s. *in cis* activity of rAPOBEC1

Y-axis: Percent of total sequencing reads with target C·G base pair converted to T·A Y-axis values: 0, 20, 40, 60

X-axis: Genomic target — Site 1, Site 2, Site 3, Site 4

*FIG. 13*

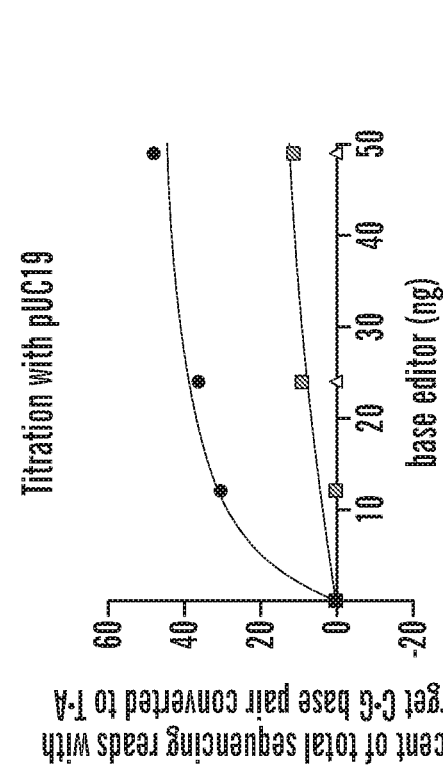
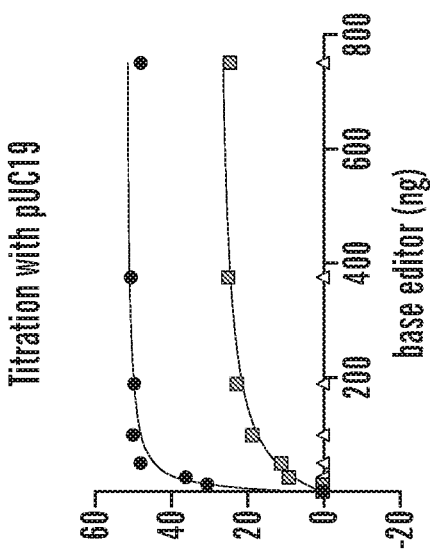
Dose-response for the *in-cis* and *in-trans* activities
A careful exam of the curve at low concentration is being performed.
*FIG. 18* guide position

NUCLEOBASE EDITORS HAVING REDUCED NON-TARGET DEAMINATION AND ASSAYS FOR CHARACTERIZING NUCLEOBASE EDITORS

CROSS-REFERENCE

This application is the U.S. national phase application, pursuant to 35 U.S.C. § 371, of PCT International Application No. PCT/US2020/016285, filed Jan. 31, 2020, which claims the benefit of U.S. Provisional Patent Application No. 62/799,702, filed Jan. 31, 2019, the contents of each of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Mar. 11, 2020, is named 180802-041704-SL.txt and is 1,496,992 bytes in size.

BACKGROUND OF THE INVENTION

Deaminases combined with the precise targeting of CRISPR-Cas proteins, termed nucleobase editors, have the ability to introduce specific point mutations into target polynucleotides. Nucleobase editors induce base changes without introducing double-stranded DNA breaks, and include adenosine base editors that convert target A·T to G·C and cytidine base editors that convert target C·G to T·A. However, introduction of nucleobase editors in cells has the potential to generate undesired base editor-associated edits, including genome-wide spurious deamination, bystander mutation, and target proximal edits. Spurious deamination events may occur throughout the genome, catalyzed by the base editor deamination domain acting independently of targeted base editing via programming of CRISPR-Cas domain by a guide RNA. Without being bound by theory, genome-wide spurious deamination events have the potential to occur where a single stranded DNA substrate is formed, for example due to "DNA breathing" or at DNA replication forks. Target proximal edits are base editing events that occur outside the on-target sequence, but are within ~200 bp upstream or downstream of the targeted region. Bystander mutations are mutations that occur within the on-target, Cas9/sgRNA guided, base editing window which are not the desired target nucleobase. Bystander mutation may result in either silent mutation (no amino acid change) or non-synonymous mutation (amino acid change). Thus, there is a need for base editors having reduced non-target deamination.

SUMMARY OF THE INVENTION

As described below, the present invention features nucleobase editor compositions and methods and assays for characterizing nucleobase editors as having decreased non-target deamination, e.g. compared to programmed, on-target deamination.

Compositions and articles defined by the invention were isolated or otherwise manufactured in connection with the examples provided below. Other features and advantages of the invention will be apparent from the detailed description, and from the claims.

In one aspect provided herein is a fusion protein comprising a deaminase inserted within a flexible loop of a Cas9 polypeptide, wherein the fusion protein comprises the structure:

NH2-[N-terminal fragment of a Cas9]-[deaminase]-[C-terminal fragment of a Cas9]-COOH, wherein each instance of "]-[" is an optional linker.

In one aspect provided herein is a fusion protein comprising a deaminase flanked by a N-terminal fragment and a C-terminal fragment of a Cas9 polypeptide, wherein the C-terminus of the N terminal fragment or the N-terminus of the C terminal fragment comprises a part of a flexible loop of the Cas9 polypeptide.

In some embodiments, the deaminase of the fusion protein deaminates a target nucleobase in a target polynucleotide sequence. In some embodiments, the flexible loop comprises an amino acid in proximity to the target nucleobase when the fusion protein deaminates the target nucleobase. In some embodiments, the flexible loop comprises a part of an alpha-helix structure of the Cas9 polypeptide. In some embodiments, the target nucleobase is deaminated with lower off-target deamination as compared to an end terminus fusion protein comprising the deaminase fused to a N terminus or a C terminus of SEQ ID NO: 1.

In some embodiments, the target nucleobase is 1-20 nucleobases away from a Protospacer Adjacent Motif (PAM) sequence in the target polynucleotide sequence. In some embodiments, the target nucleobase is 2-12 nucleobases upstream of the PAM sequence. In some embodiments, the flexible loop comprises a region selected from the group consisting of amino acid residues at positions 530-537, 569-579, 686-691, 768-793, 943-947, 1002-1040, 1052-1077, 1232-1248, and 1298-1300 as numbered in SEQ ID NO: 1, or a corresponding region thereof. In some embodiments, the deaminase is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in SEQ ID NO: 1 or corresponding amino acid positions thereof.

In some embodiments, the deaminase is inserted between amino acid positions 768-769, 792-793, 1022-1023, 1026-1027, 1040-1041, 1068-1069, or 1247-1248 as numbered in SEQ ID NO: 1 or corresponding amino acid positions thereof. In some embodiments, the deaminase is inserted between amino acid positions 1016-1017, 1023-1024, 1029-1030, 1040-1041, 1069-1070 or 1247-1248 as numbered in SEQ ID NO: 1 or corresponding amino acid positions thereof.

In some embodiments, the N-terminal fragment comprises amino acid residues 1-529, 538-568, 580-685, 692-942, 948-1001, 1026-1051, 1078-1231, and/or 1248-1297 of the Cas9 polypeptide as numbered in SEQ ID NO: 1, or corresponding residues thereof. In some embodiments, the C-terminal fragment comprises amino acid residues 1301-1368, 1248-1297, 1078-1231, 1026-1051, 948-1001, 692-942, 580-685, and/or 538-568 of the Cas9 polypeptide as numbered SEQ ID NO: 1, or corresponding residues thereof. In some embodiments, the N terminal fragment or the C terminal fragment of the Cas9 polypeptide binds the target polynucleotide sequence.

In some embodiments, the N-terminal fragment or the C-terminal fragment of the Cas9 polypeptide comprises a DNA binding domain. In some embodiments, the N-terminal fragment or the C-terminal fragment comprises a RuvC domain. In some embodiments, the N-terminal fragment or the C terminal fragment comprises a HNH domain. In some embodiments, neither of the N-terminal fragment and the C-terminal fragment comprises a HNH domain. In some embodiments, neither of the N-terminal fragment and the C-terminal fragment comprises a RuvC domain. In some embodiments, the Cas9 polypeptide comprises a partial or complete deletion in one or more structural domains. In some embodiments, the deaminase is inserted at the partial or complete deletion position of the Cas9 polypeptide.

In some embodiments, the deletion is within a RuvC domain. In some embodiments, the deletion is within an HNH domain. In some embodiments, the deletion bridges a RuvC domain and a C-terminal domain, a L-I domain and a HNH domain, or a RuvC domain and a L-I domain. In some embodiments, the Cas9 polypeptide comprises a deletion of amino acids 1017-1069 as numbered in SEQ ID NO: 1 or corresponding amino acids thereof. In some embodiments, the Cas9 polypeptide comprises a deletion of amino acids 792-872 as numbered in SEQ ID NO: 1 or corresponding amino acids thereof. In some embodiments, the Cas9 polypeptide comprises a deletion of amino acids 792-906 as numbered in SEQ ID NO: 1 or corresponding amino acids thereof.

In one aspect, provided herein is a fusion protein comprising a deaminase inserted within a Cas9 polypeptide, wherein the fusion protein comprises the structure:

NH2-[N-terminal fragment of a Cas9]-[deaminase]-[C-terminal fragment of a Cas9]-COOH, wherein each instance of "]-[" is an optional linker, wherein the Cas9 polypeptide comprises a complete deletion of a HNH domain, and wherein the deaminase is inserted at the deletion position.

In some embodiments, the C terminal amino acid of the N terminal fragment is amino acid 791 as numbered in SEQ ID NO: 1. In some embodiments, the N terminal amino acid of the C terminal fragment is amino acid 907 as numbered in SEQ ID NO: 1. In some embodiments, the N terminal amino acid of the C terminal fragment is amino acid 873 as numbered in SEQ ID NO: 1.

In one aspect provided herein is a fusion protein comprising a deaminase inserted within a Cas9 polypeptide, wherein the fusion protein comprises the structure:

NH2-[N-terminal fragment of a Cas9]-[deaminase]-[C-terminal fragment of a Cas9]-COOH, wherein each instance of "]-[" is an optional linker, and wherein the Cas9 comprises a complete deletion of a RuvC domain and wherein the deaminase is inserted at the deletion position.

In some embodiments, the deaminase is a cytidine deaminase or an adenosine deaminase. In some embodiments, the cytidine deaminase is an APOBEC cytidine deaminase, an activation induced cytidine deaminase (AID), or a CDA. In some embodiments, the APOBEC deaminase is APOBEC1, APOBEC2, APOBEC3A, APOBEC3B, APOBEC3C, APOBEC3D, APOBEC3E, APOBEC3F, APOBEC3G, APOBEC3H, or APOBEC4. In some embodiments, the APOBEC deaminase is rAPOBEC1. In some embodiments, the fusion protein of any one of aspects above further comprises a UGI domain.

In some embodiments, the adenosine deaminase is a TadA deaminase. In some embodiments, the TadA deaminase is a modified TadA. In some embodiments, the TadA deaminase is a TadA 7.10. In some embodiments, the adenosine deaminase is a TadA dimer. In some embodiments, the TadA dimer comprises a TadA 7.10 and a wild type TadA. In some embodiments, the optional linker comprises (SGGS)n (SEQ ID NO: 2), (GGGS)n (SEQ ID NO: 3), (GGGGS)n (SEQ ID NO: 4), (G)n (SEQ ID NO: 5), (EAAAK)n (SEQ ID NO: 6), (GGS)n (SEQ ID NO: 7), SGSETPGTSESATPES (SEQ ID NO: 8), or (XP)n motif (SEQ ID NO: 9), or a combination thereof, wherein n is independently an integer between 1 and 30.

In some embodiments, the N terminal fragment of the Cas9 polypeptide is fused to the deaminase without a linker. In some embodiments, the C terminal fragment of the Cas9 is fused to the deaminase without a linker. In some embodiments, the fusion protein of any one of aspects above, further comprises an additional catalytic domain.

In some embodiments, the additional catalytic domain is a second deaminase. In some embodiments, the second deaminase is fused to the N terminus or the C terminus of the fusion protein. In some embodiments, the deaminase is a cytidine deaminase or an adenosine deaminase. In some embodiments, the fusion protein of any one of aspects above further comprises a nuclear localization signal. In some embodiments, the nuclear localization signal is a bipartite nuclear localization signal. In some embodiments, the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or variants thereof. In some embodiments, the Cas9 polypeptide is a modified Cas9 and has specificity for an altered PAM. In some embodiments, the Cas9 polypeptide is a nickase. In some embodiments, the Cas9 polypeptide is nuclease inactive. In some embodiments, the fusion protein of any one of aspects above in complex with a guide nucleic acid sequence to effect deamination of the target nucleobase. In some embodiments, the fusion protein is further complexed with the target polynucleotide.

Provided herein is a polynucleotide encoding the fusion protein of any one of aspects above.

Provided herein is an expression vector comprising the polynucleotide described above.

In some embodiments, the expression vector is a mammalian expression vector. In some embodiments, the vector is a viral vector selected from the group consisting of adeno-associated virus (AAV), retroviral vector, adenoviral vector, lentiviral vector, Sendai virus vector, and herpesvirus vector. In some embodiments, the vector comprises a promoter.

Provided herein is a cell comprising the fusion protein of any one of aspects above, the polynucleotide described above, or the vector described above.

In some embodiments, the cell is a bacterial cell, plant cell, insect cell, a human cell, or mammalian cell.

Provided herein is a kit comprising the fusion protein of any one of aspects above, the polynucleotide described above, or the vector described above.

Provided herein is a method for base editing comprising contacting a polynucleotide sequence with the fusion protein of any one of aspects above, wherein the deaminase of the fusion protein deaminates a nucleobase in the polynucleotide, thereby editing the polynucleotide sequence.

In some embodiments, the method further comprises contacting the target polynucleotide sequence with a guide nucleic acid sequence to effect deamination of the target nucleobase.

In one aspect, provided herein is a method for editing a target nucleobase in a target polynucleotide sequence, the method comprising: contacting the target polynucleotide sequence with a fusion protein comprising a deaminase flanked by a N-terminal fragment and a C-terminal fragments of a Cas9 polypeptide, wherein the deaminase of the fusion protein deaminates the target nucleobase in the target polynucleotide sequence, and wherein the C-terminus of the N terminal fragment or the N-terminus of the C terminal fragment comprises a part of a flexible loop of the Cas9 polypeptide.

Provided herein is a method for editing a target nucleobase in a target polynucleotide sequence, the method comprising: contacting the target polynucleotide sequence with a fusion protein comprising a deaminase inserted within a flexible loop of a Cas9 polypeptide, wherein the fusion protein comprises the structure NH2-[N-terminal fragment of a Cas9]-[deaminase]-[C-terminal fragment of a Cas9]-COOH, wherein each instance of "]-[" is an optional linker, wherein the deaminase of the fusion protein deaminates the target nucleobase in the target polynucleotide sequence.

In some embodiments, the method further comprises contacting the target polynucleotide sequence with a guide nucleic acid sequence to effect deamination of the target nucleobase. In some embodiments, the guide nucleic acid sequence comprises a spacer sequence complementary to a protospacer sequence of the target polynucleotide sequence, thereby forming a R-loop. In some embodiments, the target nucleobase is deaminated with lower off-target deamination as compared to an end terminus method comprising the deaminase fused to a N terminus or a C terminus of SEQ ID NO: 1. In some embodiments, the deaminase of the fusion protein deaminates no more than two nucleobases within the range of the R-loop. In some embodiments, the target nucleobase is 1-20 nucleobases away from a PAM sequence in the target polynucleotide sequence. In some embodiments, the target nucleobase is 2-12 nucleobases upstream of the PAM sequence.

In some embodiments, the flexible loop comprises an amino acid in proximity to the target nucleobase when the deaminase of the fusion protein deaminates the target nucleobase. In some embodiments, the flexible loop comprises a region selected from the group consisting of amino acid residues at positions 530-537, 569-579, 686-691, 768-793, 943-947, 1002-1040, 1052-1077, 1232-1248, and 1298-1300 as numbered in SEQ ID NO: 1, or a corresponding region thereof. In some embodiments, the deaminase is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in SEQ ID NO: 1 or corresponding amino acid positions thereof. In some embodiments, the deaminase is inserted between amino acid positions 768-769, 792-793, 1022-1023, 1026-1027, 1040-1041, 1068-1069, or 1247-1248 as numbered in SEQ ID NO: 1 or corresponding amino acid positions thereof. In some embodiments, the deaminase is inserted between amino acid positions 1016-1017, 1023-1024, 1029-1030, 1040-1041, 1069-1070 or 1247-1248 as numbered in SEQ ID NO: 1 or corresponding amino acid positions thereof.

In some embodiments, the N-terminal fragment comprises amino acid residues 1-529, 538-568, 580-685, 692-942, 948-1001, 1026-1051, 1078-1231, and/or 1248-1297 of the Cas9 polypeptide as numbered in SEQ ID NO: 1, or corresponding residues thereof. In some embodiments, the C-terminal fragment comprises amino acid residues 1301-1368, 1248-1297, 1078-1231, 1026-1051, 948-1001, 692-942, 580-685, and/or 538-568 of the Cas9 polypeptide as numbered SEQ ID NO: 1, or corresponding residues thereof. In some embodiments, the N terminal fragment or the C terminal fragment of the Cas9 polypeptide binds the target polynucleotide sequence. In some embodiments, the N-terminal fragment or the C-terminal fragment comprises a RuvC domain. In some embodiments, the N-terminal fragment or the C-terminal fragment comprises a HNH domain. In some embodiments, neither of the N-terminal fragment and the C-terminal fragment comprises a HNH domain. In some embodiments, neither of the N-terminal fragment and the C-terminal fragment comprises a RuvC domain.

In some embodiments, the Cas9 polypeptide comprises a partial or complete deletion in one or more structural domains. In some embodiments, the deaminase is inserted at the partial or complete deletion position of the Cas9 polypeptide. In some embodiments, the deletion is within a RuvC domain. In some embodiments, the deletion is within an HNH domain. In some embodiments, the deletion bridges a RuvC domain and a C-terminal domain, a L-I domain and a HNH domain, or a RuvC domain and a L-I domain. In some embodiments, the Cas9 polypeptide comprises a deletion of amino acids 1017-1069 as numbered in SEQ ID NO: 1 or corresponding amino acids thereof.

In some embodiments, the Cas9 polypeptide comprises a deletion of amino acids 792-872 as numbered in SEQ ID NO: 1 or corresponding amino acids thereof. In some embodiments, the Cas9 polypeptide comprises a deletion of amino acids 792-906 as numbered in SEQ ID NO: 1 or corresponding amino acids thereof. In some embodiments, the deaminase is a cytidine deaminase. In some embodiments, the deaminase is an adenosine deaminase. In some embodiments, the Cas9 polypeptide is a modified Cas9 and has specificity for an altered protospacer-adjacent motif (PAM). In some embodiments, the Cas9 polypeptide is a nickase. In some embodiments, the Cas9 polypeptide is nuclease inactive.

In some embodiments, the contacting is performed in a cell. In some embodiments, the cell is a mammalian cell or a human cell. In some embodiments, the cell is a pluripotent cell. In some embodiments, the cell is in vivo or ex vivo. In some embodiments, the contacting is performed in a population of cells. In some embodiments, the population of cells are mammalian cells or human cells.

In one aspect provided herein is a method for treating a genetic condition in a subject, the method comprising: administering to the subject a fusion protein comprising a deaminase flanked by a N-terminal fragment and a C-terminal fragment of a Cas9 polypeptide or a polynucleotide encoding the fusion protein, and a guide nucleic acid sequence or a polynucleotide encoding the guide nucleic acid sequence, wherein the guide nucleic acid sequence directs the fusion protein to deaminate a target nucleobase in a target polynucleotide sequence of the subject, thereby treating the genetic condition.

Provided herein is a method for treating a genetic condition in a subject, the method comprising: administering to the subject a fusion protein comprising a deaminase inserted within a flexible loop of a Cas9 polypeptide, wherein the fusion protein comprises the structure NH2-[N-terminal fragment of a Cas9]-[deaminase]-[C-terminal fragment of a Cas9]-COOH, wherein each instance of "]-[" is an optional linker, wherein the deaminase of the fusion protein deaminates the target nucleobase in the target polynucleotide sequence of the subject, thereby treating the genetic condition.

In some embodiments, the C-terminus of the N terminal fragment or the N-terminus of the C terminal fragment comprises a part of a flexible loop of the Cas9 polypeptide. In some embodiments, the method further comprises administering to the subject a guide nucleic acid sequence to effect deamination of the target nucleobase. In some embodiments, the target nucleobase comprises a mutation associated with the genetic condition. In some embodiments, the deamination of the target nucleobase replaces the target nucleobase with a wild type nucleobase. In some embodiments, the deamination of the target nucleobase replaces the target nucleobase with a non-wild type nucleobase, and wherein the deamination of the target nucleobase ameliorates symptoms of the genetic condition.

In some embodiments, the target polynucleotide sequence comprises a mutation associated with the genetic condition at a nucleobase other than the target nucleobase. In some embodiments, the deamination of the target nucleobase ameliorates symptoms of the genetic condition. In some embodiments, the target nucleobase is 1-20 nucleobases away from a PAM sequence in the target polynucleotide sequence. In some embodiments, the target nucleobase is 2-12 nucleobases upstream of the PAM sequence. In some embodiments, the flexible loop comprises an amino acid in proximity to the target nucleobase when the deaminase of the fusion protein deaminates the target nucleobase.

In some embodiments, the flexible loop comprises a region selected from the group consisting of amino acid residues at positions 530-537, 569-579, 686-691, 768-793, 943-947, 1002-1040, 1052-1077, 1232-1248, and 1298-1300 as numbered in SEQ ID NO: 1, or a corresponding region thereof.

In some embodiments, the deaminase is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in SEQ ID NO: 1 or corresponding amino acid positions thereof. In some embodiments, the deaminase is inserted between amino acid positions 768-769, 792-793, 1022-1023, 1026-1027, 1040-1041, 1068-1069, or 1247-1248 as numbered in SEQ ID NO: 1 or corresponding amino acid positions thereof. In some embodiments, the deaminase is inserted between amino acid positions 1016-1017, 1023-1024, 1029-1030, 1040-1041, 1069-1070 or 1247-1248 as numbered in SEQ ID NO: 1 or corresponding amino acid positions thereof.

In some embodiments, the N-terminal fragment comprises amino acid residues 1-529, 538-568, 580-685, 692-942, 948-1001, 1026-1051, 1078-1231, and/or 1248-1297 of the Cas9 polypeptide as numbered in SEQ ID NO: 1, or corresponding residues thereof. In some embodiments, the C-terminal fragment comprises amino acid residues 1301-1368, 1248-1297, 1078-1231, 1026-1051, 948-1001, 692-942, 580-685, and/or 538-568 of the Cas9 polypeptide as numbered SEQ ID NO: 1, or corresponding residues thereof. In some embodiments, the N terminal fragment or the C terminal fragment of the Cas9 polypeptide binds the target polynucleotide sequence. In some embodiments, the N-terminal fragment or the C-terminal fragment comprises a RuvC domain. In some embodiments, the N-terminal fragment or the C-terminal fragment comprises a HNH domain.

In some embodiments, neither of the N-terminal fragment and the C-terminal fragment comprises a HNH domain. In some embodiments, neither of the N-terminal fragment and the C-terminal fragment comprises a RuvC domain. In some embodiments, the Cas9 polypeptide comprises a partial or complete deletion in one or more structural domains. In some embodiments, the deaminase is inserted at the partial or complete deletion position of the Cas9 polypeptide. In some embodiments, the deletion is within a RuvC domain. In some embodiments, the deletion is within an HNH domain. In some embodiments, the deletion bridges a RuvC domain and a C-terminal domain, a L-I domain and a HNH domain, or a RuvC domain and a L-I domain. In some embodiments, the Cas9 polypeptide comprises a deletion of amino acids 1017-1069 as numbered in SEQ ID NO: 1 or corresponding amino acids thereof.

In some embodiments, the Cas9 polypeptide comprises a deletion of amino acids 792-872 as numbered in SEQ ID NO: 1 or corresponding amino acids thereof. In some embodiments, the Cas9 polypeptide comprises a deletion of amino acids 792-906 as numbered in SEQ ID NO: 1 or corresponding amino acids thereof. In some embodiments, the deaminase is a cytidine deaminase. In some embodiments, the deaminase is an adenosine deaminase. In some embodiments, the Cas9 polypeptide is a modified Cas9 and has specificity for an altered PAM. In some embodiments, the Cas9 polypeptide is a nickase. In some embodiments, the Cas9 polypeptide is nuclease inactive. In some embodiments, the subject is a mammal. In some embodiments, the subject is a human.

Provided herein is a protein library for optimized base editing comprising a plurality of fusion proteins, wherein each one of the plurality of fusion proteins comprises a deaminase flanked by a N-terminal fragment and a C-terminal fragment of a Cas9 polypeptide, wherein the N-terminal fragment of each one of the fusion proteins differs from the N-terminal fragments of the rest of the plurality of fusion proteins or wherein the C-terminal fragment of each one of the fusion proteins differs from the C-terminal fragments of the rest of the plurality of fusion proteins, wherein the deaminase of each one of the fusion proteins deaminates a target nucleobase in proximity to a Protospacer Adjacent Motif (PAM) sequence in a target polynucleotide sequence, and wherein the N terminal fragment or the C terminal fragment binds the target polynucleotide sequence.

In some embodiments, for each nucleobase from 1 to 20 nucleobases away of the PAM sequence, at least one of the plurality of fusion proteins deaminates the nucleobase. In some embodiments, the C-terminus of the N terminal fragment or the N-terminus of the C terminal fragment of the Cas9 polypeptide of each one of the plurality of fusion proteins comprises a part of a flexible loop of the Cas9 polypeptide. In some embodiments, at least one of the plurality of fusion proteins deaminates the target nucleobase with lower off-target deamination as compared to an end terminus fusion protein comprising the deaminase fused to a N terminus or a C terminus of SEQ ID NO: 1. In some embodiments, at least one of the plurality of the fusion proteins deaminates a target nucleobase 2-12 nucleobases upstream of the PAM sequence. In some embodiments, the C-terminus of the N terminal fragment or the N-terminus of the C terminal fragment of a fusion protein of the plurality comprises an amino acid in proximity to the target nucleobase when the fusion protein deaminates the target nucleobase.

In some embodiments, the deaminase of at least one of the fusion proteins is between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in SEQ ID NO: 1 or corresponding amino acid positions thereof. In some embodiments, the deaminase of at least one of the fusion proteins is between amino acid positions 768-769, 792-793, 1022-1023, 1026-1027, 1040-1041, 1068-1069, or 1247-1248 as numbered in SEQ ID NO: 1 or corresponding amino acid positions thereof. In some embodiments, the deaminase of at least one of the fusion proteins is between amino acid positions 1016-1017, 1023-1024, 1029-1030, 1040-1041, 1069-1070 or 1247-1248 as numbered in SEQ ID NO: 1 or corresponding amino acid positions thereof. In some embodiments, the deaminase is an adenosine deaminase. In some embodiments, the deaminase is a cytidine deaminase.

In some embodiments, the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or variants thereof. In some embodiments, the Cas9 polypeptide is a modified Cas9 and has specificity for an altered protospacer-adjacent motif (PAM). In some embodiments, the Cas9 polypeptide is a nickase. In some embodiments, the Cas9 polypeptide is nuclease inactive.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as, *E. coli, S. aureus, S. typhi, S. putrefaciens, H. influenzae,* or *C. crescentus.* In some embodiments, the adenosine deaminase is a TadA deaminase. In some embodiments, the TadA deaminase is an *E. coli* TadA (ecTadA) deaminase or a fragment thereof.

For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine. In some embodiments, the TadA deaminase is an N-terminal truncated TadA. In particular embodiments, the TadA is any one of the TadA described in PCT/US2017/045381, which is incorporated herein by reference in its entirety.

In certain embodiments, the adenosine deaminase comprises the amino acid sequence:

```
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLBHPGMNBRVEITEGILADECAALLSDFFR

MRRQEIKAQKKAQSSTD,
``` which is termed "the TadA reference sequence".

In some embodiments the TadA deaminase is a full-length *E. coli* TadA deaminase. For example, in certain embodiments, the adenosine deaminase comprises the amino acid sequence:

```
MRRAFITGVFFLSEVEFSHEYWMRHALTLAKRAWDEREVPVGAVLVHNN

RVIGEGWNRPIGRHDPTAHAEIMALRQGGLVMQNYRLIDATLYVTLEPC

VMCAGAMIHSRIGRVVFGARDAKTGAAGSLMDVLHHPGMNEIRVEITEG

ILADECAALLSDFFRMRRQEIKAQKKAQSSTD
```

It should be appreciated, however, that additional adenosine deaminases useful in the present application would be apparent to the skilled artisan and are within the scope of this disclosure. For example, the adenosine deaminase may be a homolog of adenosine deaminase acting on tRNA (AD AT). Exemplary AD AT homologs include, without limitation:

```
Staphylococcus aureus TadA:
MGSHMTNDIYFMTLAIEEAKKAAQLGEVPIGAIITKDDEVIARAHNLRE

TLQQPTAHAEHIAIERAAKVLGSWRLEGCTLYVTLEPCVMCAGTIVMSR

IPRVVYGADDPKGGCSGSLMNLLQQSNFNHRAIVDKGVLKEACSTLLTT

FFKNLRANKKSTN

Bacillus subtilis TadA:
MTQDELYMKEAIKEAKKAEEKGEVPIGAVLVINGEIIARAHNLRETEQR

SIAHAEMLVIDEACKALGTWRLEGATLYVTLEPCPMCAGAVVLSRVEKV

VFGAFDPKGGCSGTLMNLLQEERFNHQAEVVSGVLEEECGGMLSAFFRE

LRKKKKAARKNLSE
```

-continued

Salmonella typhimurium (S. typhimurium) TadA:
MPPAFITGVTSLSDVELDHEYWMRHALTLAKRAWDEREVPVGAVLVHNI

ARVIGEGWNRPIGRHDPTAHAEIMALRQGGLVLQNYRLLDTTLYVTLEP

CVMCAGAMVHSRIGRVVFGARDAKTGAAGSLIDVLHIHPGMNHRVEIIE

GVLRDECATLLSDFFRMRRQEIKALKKADRAEGAGPAV

Shewanella putrefaciens (S. putrefaciens) TadA:
MDEYWMQVAMQMAEKAEAAGEVPVGAVLVKDGQQIATGYNLSISQHDPT

AHAEI

LCLRSAGKKLENYRLLDATLYITLEPCAMCAGAMVHSRIARVVYGARDE

KTGAAGTVVNLLQHPAFNHQVEVTSGVLAEACSAQLSRFFKRRRDEKKA

LKLAQRAQQGIE

Haemophilus influenzae F3031 (H. influenzae) TadA:
MDAAKVRSEFDEKMMRYALELADKAEALGEIPVGAVLVDDARNIIGEGW

NLSIVQSDPTAHAEIIALRNGAKNIQNYRLLNSTLYVTLEPCTMCAGAI

LHSRIKRLVFGASDYK

TGAIGSRFHFFDDYKIVINHTLEITSGVLAEECSQKLSTFFQKRREEKK

IEKALLKSLSDK

Caulobacter crescentus (C. crescentus) TadA:
MRTDESEDQDHRMMRLALDAARAAAEAGETPVGAVILDPSTGEVIATAG

NGPIAAHDPTAHAEIAAMRAAAAKLGNYRLTDLTLVVTLEPCAMCAGAI

SHARIGRVVFGADDPKGGAVVHGPKFFAQPTCHWRPEVTGGVLADESAD

LLRGFFRARRKAKI

Geobacter sulfurreducens (G. sulfurreducens) TadA:
MSSLKKTPIRDDAYWMGKAIREAAKAAARDEVPIGAVIVRDGAVIGRGH

NLREGSNDPSAHAEMIAIRQAARRSANWRLTGATLYVTLEPCLMCMGAI

ILARLERVVFGCYDPKGGAAGSLYDLSADPRLNHQVRLSPGVCQEECGT

MLSDFFRDLRRRKKAKATPALFIDERKVPPEP

TadA7.10
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD

Exemplary sequences containing TadA7.10 or

TadA7.10 variants include
GSSGSETPGTSESATPESSGSEVEFSHEYVVMRHALTLAKRARDEREVP

VGAVLVLNNRVIGEGWNRAIGLHDPTAHAEIMALRQGGLVMQNYRLIDA

TLYVTFEPCVMCAGAMIHSRIGRVVFGVRNAKTGAAGSLMDVLHYPGMN

EIRVEITEGILADECAALLCYFFRMPRQVFNAQKKAQSSTD

TadA7.10 CP65
TAHAEIMALRQGGLVMQNYRLIDATLYVTFEPCVMCAGAMIHSRIGRVV

FGVRNAKTGAAGSLMDVLHYPGMNHRVEITEGILADECAALLCYFFRMP

RQVFNAQKKAQSSTDGSSGSETPGTSESATPESSGSEVEFSHEYWMRHA

LTLAKRARDEREVPVGAVLVLNNRVIGEGWNRAIGLHDP

-continued

TadA7.10 CP83
YRLIDATLYVTFEPCVMCAGAMIHSRIGRVVFGVRNAKTGAAGSLMDVL

HYPGMNEIRVEITEGILADECAALLCYFERMPRQVFNAQKKAQSSTDGS

SGSETPGTSESATPESSGSEVEFSHEWMRHALTLAKRARDEREVPVGAV

LVLNNRVIGEGWNRAIGLHDPTAHAEIMALRQGGLVMQN

TadA7.10 CP136
MNHRVEITEGILADECAALLCYFFRMPRQVFNAQKKAQSSTDGSSGSET

PGTSESATPESSGSEVEFSHEYWMRHALTLAKRARDEREVPVGAVLVLN

NRVIGEGWNRAIGLEEDPTAHAEIMALRQGGLVMQNYRLIDATLYVTFE

PCVMCAGAMIHSRIGRVVFGVRNAKTGAAGSLMDVLHYPG

TadA7.10 C-truncate
GSSGSETPGTSESATPESSGSEVEFSHEYVVMRHALTLAKRARDEREVP

VGAVLVLNNRVIGEGWNRAIGLHDPTAHAEININALRQGGLVMQNYRLID

ATLYVTFEPCVMCAGAMIFISRIGRVVEGVRNAKTGAAGSLMDVLHYPG

MNEIRVEITEGILADECAALLCYFFRMPRQVFN

TadA7.10 C-truncate 2
GSSGSETPGTSESATPESSGSEVEFSHEYVVMRHALTLAKRARDEREVP

VGAVLVLNNRVIGEGWNRAIGLHDPTAHAEIMALRQGGLVMQNYRLIDA

TLYVTFEPCVMCAGAMIHSRIGRVVEGVRNAKTGAAGSLMDVLHYPGMN

EIRVEITEGILADECAALLCYFFRMPRQ

TadA7.10 delta59-66 + C-truncate
GSSGSETPGTSESATPESSGSEVEFSHEYVVMRHALTLAKRARDEREVP

VGAVLVLNNRVIGEGWNRAHAEIMALRQGGLVMQNYRLIDATLYVTFEP

CVMCAGAMIHSRIGRVVFGVRNAKTGAAGSLMDVLHYPGMNHRVEITEG

ILADECAALLCYFFRMPRQVFN

TadA7.10 delta 59-66
GSSGSETPGTSESATPESSGSEVEFSHEYVVMRHALTLAKRARDEREVP

VGAVLVLNNRVIGEGWNRAHAHMALRQGGLVMQNYRUDATLYVTFEPCV

MCAGAMIHSRIGRVVFGVRNAKTGAAGSLMDVLHYPGMNHRVEITEGIL

ADECAALLCYFFRMPRQVFNAQKKAQSSTD

By "agent" is meant any small molecule chemical compound, antibody, nucleic acid molecule, or polypeptide, or fragments thereof.

By "alter a mutation"

By "alteration" is meant a change in the structure, expression levels or activity of a gene or polypeptide as detected by standard art known methods such as those described herein. As used herein, an alteration (e.g., increase or decrease) includes a 10% change in expression levels, a 25% change, a 40% change, and a 50% or greater change in expression levels.

By "analog" is meant a molecule that is not identical, but has analogous functional or structural features. For example, a polynucleotide analog retains the biological activity of a corresponding naturally-occurring polynucleotide while having certain modifications that enhance the analog's function relative to a naturally occurring polynucleotide. Such modifications could increase the polynucleotide's affinity for DNA, half-life, and/or nuclease resistance. An analog may include an unnatural nucleotide or amino acid.

In this disclosure, "comprises," "comprising," "containing" and "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

By "base editor (BE)," or "nucleobase editor (NBE)" is meant an agent that binds a polynucleotide and has nucleobase modifying activity. In one embodiment, the agent is a fusion protein comprising a domain having base editing activity, i.e., a domain capable of modifying a base (e.g., A, T, C, G, or U) within a nucleic acid molecule (e.g., DNA). In some embodiments, the domain having base editing activity is capable of deaminating a base within a nucleic acid molecule. In some embodiments, the base editor is capable of deaminating a base within a DNA molecule. In some embodiments, the base editor is capable of deaminating a cytosine (C) or an adenosine within DNA. In some embodiments, the base editor is a cytidine base editor (CBE). In some embodiments, the base editor is an adenosine base editor (ABE). In some embodiments, the base editor is an adenosine base editor (ABE) and a cytidine base editor (CBE). In some embodiments, the base editor is a nuclease-inactive Cas9 (dCas9) fused to an adenosine deaminase. In some embodiments, the Cas9 is a circular permutant Cas9 (e.g., spCas9 or saCas9). Circular permutant Cas9s are known in the art and described, for example, in Oakes et al., Cell 176, 254-267, 2019. In some embodiments, the base editor is fused to an inhibitor of base excision repair, for example, a UGI domain. In some embodiments, the fusion protein comprises a Cas9 nickase fused to a deaminase and an inhibitor of base excision repair, such as a UGI domain. In other embodiments the base editor is an abasic base editor.

In some embodiments, an adenosine deaminase is evolved from TadA. In some embodiments, the polynucleotide programmable DNA binding domain is a CRISPR associated (e.g., Cas or Cpf1) enzyme. In some embodiments, the base editor is a catalytically dead Cas9 (dCas9) fused to a deaminase domain. In some embodiments, the base editor is a Cas9 nickase (nCas9) fused to a deaminase domain. In some embodiments, the deaminase domain is a N-terminal or C-terminal fragment of the polynucleotide programmable DNA binding domain. In some embodiments, the deaminase is flanked by an N-terminal and C-terminal fragment of a polynucleotide programmable DNA binding domain. In some embodiments, the deaminase domain is inserted into a site of the polynucleotide programmable DNA binding domain. In some embodiments, the base editor is fused to an inhibitor of base excision repair (BER). In some embodiments, the inhibitor of base excision repair is a uracil DNA glycosylase inhibitor (UGI). In some embodiments, the inhibitor of base excision repair is an inosine base excision repair inhibitor. Details of base editors are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

In some embodiments, the deaminase domain is inserted into regions of the polynucleotide programmable DNA binding domain. In some embodiments, the insertion site is determined by structural analysis of an napDNAbp. In some embodiments, the insertion site is a flexible loop. In some embodiments, the deaminase domain is inserted into a site in the polynucleotide programmable DNA binding domain, wherein the site is selected from at least one from a group of amino acid positions consisting of 1029, 1026, 1054, 1022, 1015, 1068, 1247, 1040, 1248, and 768. In some embodiments, the deaminase domain is inserted in place of a domain of polynucleotide programmable DNA binding domain. In some embodiments, the domain is selected from the group consisting of RuvC, Rec1, Rec2, and HNH. In some embodiments, the deaminase domain in inserted in place of a range of amino acid residues in the polynucleotide programmable DNA binding domain, wherein in the range of amino acid residues are selected from a group consisting of residues 530-537, 569-579, 686-691, 768-793, 943-947, 1002-1040, 1052-1077, 1232-1248, and 1298-1300 of Cas9 as numbered in SEQ ID NO:1 or corresponding positions thereof. It would be apparent to the skilled artisan how to identify homologous regions in a different polynucleotide programmable DNA binding domain by comparing the Cas9 amino acid sequence. In some embodiments, the base editor comprises more than one deaminase domain inserted into more than one site of a polynucleotide programmable DNA binding domain, wherein the sites are described above.

In some embodiments, base editors are generated by cloning an adenosine deaminase variant (e.g., TadA*7.10) into a scaffold that includes a circular permutant Cas9 (e.g., spCAS9) and a bipartite nuclear localization sequence. Circular permutant Cas9s are known in the art and described, for example, in Oakes et al., Cell 176, 254-267, 2019. Exemplary circular permutant sequences are set forth below, in which the bold sequence indicates sequence derived from Cas9, the italics sequence denotes a linker sequence, and the underlined sequence denotes a bipartite nuclear localization sequence.

```
CP5 (with MSP "NGC = Pam Variant with mutations Regular Cas9 likes NGG"
PID = Protein Interacting Domain and "D10A" nickase)
EIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFMQPTVAYSVLVVAKVEK

GKSKKLKSVKELLGITIMERSSFEKNPIDFLEAKGYKEVKKDLIIKLPKYSLFELENGRKRM

LASAKFLQKGNELALPSKYVNFLYLASHYEKLKGSPEDNEQKQLFVEQHKHYLDEIIEQISE
```

-continued

```
FSKRVILADANLDKVLSAYNKHRDKPIREQAENIIHLFTLTNLGAPRAFKYFDTTIARKEYR

STKEVLDATLIHQSITGLYETRIDLSQLGGDGGSGGSGGSGGSGGSGGSGGSGGMDKKYSIGLAI

GTNSVGWAVITDEYKVPSKKFKVLGNTDRHSIKKNLIGALLFDSGETAEATRLKRTARRRYT

RRKNRICYLQEIFSNEMAKVDDSFFHRLEESFLVEEDKKHERHPIFGNIVDEVAYHEKYPTI

YHLRKKLVDSTDKADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSLGLTPNFKSNFDLA

EDAKLQLSKDTYDDDLDNLLAQIGDQYADLFLAAKNLSDAILLSDILRVNTEITKAPLSASM

IKRYDEHHQDLTLLKALVRQQLPEKYKEIFFDQSKNGYAGYIDGGASQEEFYKFIKPILEKM

DGTEELLVKLNREDLLRKQRTFDNGSIPHQIHLGELHAILRRQEDFYPFLKDNREKIEKILT

FRIPYYVGPLARGNSRFAWMTRKSEETITPWNFEEVVDKGASAQSF1ERMTNFDKNLPNEKV

LPKHSLLYEYFTVYNELTKVKYVTEGMRKPAFLSGEQKKAIVDLLFKTNRKVTVKQLKEDYF

KKIECFDSVEISGVEDRFNASLGTYHDLLKIIKDKDFLDNEENEDILEDIVLTLTLFEDREM

IEERLKTYAHLFDDKVMKQLKRRRYTGWGRLSRKLINGIRDKQSGKTILDFLKSDGFANRNF

MQLIHDDSLTFKEDIQKAQVSGQGDSLHEHIANLAGSPAIKKGILQTVKVVDELVKVMGRHK

PENIVIEMARENQTTQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRGKSDNVPSEEVVKKM

KNYWRQLLNAKLITQRKFDNLTKAERGGLSELDKAGFIKRQLVETRQITKHVAQILDSRMNT

KYDENDKLIREVKVITLKSKLVSDFRKDFQFYKVREINNYHHAHDAYLNAVVGTALIKKYPK

LESEFVYGDYKVYDVRKMIAKSEQEGADKRTADGSEFESPKKKRKV*
```

The nucleobase components and the polynucleotide programmable nucleotide binding component of a base editor system may be associated with each other covalently or non-covalently. For example, in some embodiments, the deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

By "base editing activity" is meant acting to chemically alter a base within a polynucleotide. In one embodiment, a first base is converted to a second base. In one embodiment, the base editing activity is cytidine deaminase activity, e.g., converting target C·G to T·A. In another embodiment, the base editing activity is adenosine deaminase activity, e.g., converting A·T to G·C.

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (me) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., Science. 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., Science. 337:816-821(2012); Qi et al., *Cell.* 28; 152(5):1173-83 (2013)). In some embodiments, a Cas9 nuclease has an inactive (e.g., an inactivated) DNA cleavage domain, that is, the Cas9 is a nickase, referred to as an "nCas9" protein (for "nickase" Cas9). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length. In some embodiments, wild type Cas9 corresponds to Cas9 from *Streptococcus pyogenes* (NCBI Reference Sequence: NC_017053.1, nucleotide and amino acid sequences as follows).

```
ATGGATAAGAAATACTCAATAGGCTTAGATATCGGCACAAATAGCGTCGGATGGGCGGTGAT

CACTGATGATTATAAGGTTCCGTCTAAAAAGTTCAAGGTTCTGGGAAATACAGACCGCCACA

GTATCAAAAAAATCTTATAGGGGCTCTTTTATTTGGCAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGCAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAATCTACAATCAATTATTTGAAGAAAACCCTATTAACGCAAGTAGAGTAGA

TGCTAAAGCGATTCTTTCTGCACGATTGAGTAAATCAAGACGATTAGAAAATCTCATTGCTC

AGCTCCCCGGTGAGAAGAGAAATGGCTTGTTTGGGAATCTCATTGCTTTGTCATTGGGATTG

ACCCCTAATTTTAAATCAAATTTTGATTTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATAGT

GAAATAACTAAGGCTCCCCTATCAGCTTCAATGATTAAGCGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA
```

-continued

```
GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAAGTACTACCAAAACATAGTTTGCTTTATGAGTA

TTTTACGGTTTATAACGAATTGACAAAGGTCAAATATGTTACTGAGGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGCGCCTACCATGATTTGCTAAAAA

TTATTAAAGATAAAGATTTTTTGGATAATGAAGAAATGAAGATATCTTAGAGGATATTGTT

TTAACATTGACCTTATTTGAAGATAGGGGGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGATATTCAAAAAGCACAGGTGTCTGGACAAGGCCATAGTTTACATGAACAGA

TTGCTAACTTAGCTGGCAGTCCTGCTATTAAAAAAGGTATTTTACAGACTGTAAAAATTGTT

GATGAACTGGTCAAAGTAATGGGGCATAAGCCAGAAAATATCGTTATTGAAATGGCACGTGA

AAATCAGACAACTCAAAAGGGCCAGAAAAATTCGCGAGAGCGTATGAAACGAATCGAAGAAG

GTATCAAAGAATTAGGAAGTCAGATTCTTAAAGAGCATCCTGTTGAAAATACTCAATTGCAA

AATGAAAAGCTCTATCTCTATTATCTACAAAATGGAAGAGACATGTATGTGGACCAAGAATT

AGATATTAATCGTTTAAGTGATTATGATGTCGATCACATTGTTCCACAAAGTTTCATTAAAG

ACGATTCAATAGACAATAAGGTACTAACGCGTTCTGATAAAAATCGTGGTAAATCGGATAAC

GTTCCAAGTGAAGAAGTAGTCAAAAAGATGAAAAACTATTGGAGACAACTTCTAAACGCCAA

GTTAATCACTCAACGTAAGTTTGATAATTTAACGAAAGCTGAACGTGGAGGTTTGAGTGAAC

TTGATAAAGCTGGTTTTTATCAAACGCCAATTGGTTGAAACTCGCCAAATCACTAAGCATGTG

GCACAAATTTTGGATAGTCGCATGAATACTAAATACGATGAAAATGATAAACTTATTCGAGA

GGTTAAAGTGATTACCTTAAAATCTAAATTAGTTTCTGACTTCCGAAAAGATTTCCAATTCT

ATAAAGTACGTGAGATTAACAATTACCATCATGCCCATGATGCGTATCTAAATGCCGTCGTT

GGAACTGCTTTGATTAAGAAATATCCAAAACTTGAATCGGAGTTTGTCTATGGTGATTATAA

AGTTTATGATGTTCGTAAAATGATTGCTAAGTCTGAGCAAGAAATAGGCAAAGCAACCGCAA

AATATTTCTTTTACTCTAATATCATGAACTTCTTCAAAACAGAAATTACACTTGCAAATGGA

GAGATTCGCAAACGCCCTCTAATCGAAACTAATGGGGAAACTGGAGAAATTGTCTGGGATAA

AGGGCGAGATTTTGCCACAGTGCGCAAAGTATTGTCCATGCCCCAAGTCAATATTGTCAAGA

AAACAGAAGTACAGACAGGCGGATTCTCCAAGGAGTCAATTTTACCAAAAAGAAATTCGGAC

AAGCTTATTGCTCGTAAAAAAGACTGGGATCCAAAAAAATATGGTGGTTTTGATAGTCCAAC

GGTAGCTTATTCAGTCCTAGTGGTTGCTAAGGTGGAAAAAGGGAAATCGAAGAAGTTAAAAT

CCGTTAAAGAGTTACTAGGGATCACAATTATGGAAAGAAGTTCCTTTGAAAAAAAATCCGATT

GACTTTTTAGAAGCTAAAGGATATAAGGAAGTTAAAAAAGACTTAATCATTAAACTACCTAA

ATATAGTCTTTTTGAGTTAGAAAACGGTCGTAAACGGATGCTGGCTAGTGCCGGAGAATTAC

AAAAAGGAAATGAGCTGGCTCTGCCAAGCAAATATGTGAATTTTTTATATTTAGCTAGTCAT

TATGAAAAGTTGAAGGGGTAGTCCAGAAGATAACGAACAAAAACAATTGTTTGTGGAGCAGCA
```

-continued

TAAGCATTATTTAGATGAGATTATTGAGCAAATCAGTGAATTTTCTAAGCGTGTTATTTTAG

CAGATGCCAATTTAGATAAAGTTCTTAGTGCATATAACAAACATAGAGACAAACCAATACGT

GAACAAGCAGAAAATATTATTCATTTATTTACGTTGACGAATCTTGGAGCTCCCGCTGCTTT

TAAATATTTTGATACAACAATTGATCGTAAACGATATACGTCTACAAAAGAAGTTTTAGATG

CCACTCTTATCCATCAATCCATCACTGGTCTTTATGAAACACGCATTGATTTGAGTCAGCTA

GGAGGTGACTGA

MDKK<u>YSIGLDIGTNSVGWAVITDDYKVPSKKFKVLGNTDRHSIKKNLIGALLFGSGETA</u>EAT

RLKRTARRRYTRRKNRICYLQEIFSNEMAKVDDSFFHRLEESFLVEEDKKHERHPIFGNIVD

EVAYHEKYPTIYHLRKKLADSTDKADLRLIYLALAHMIKFRGHFLIEGDLNPDNSDVDKLFI

QLVQIYNQLFEENPINASRVDAKAILSARLSKSRRLENLIAQLPGEKRNGLFGNLIALSLGL

TPNFKSNFDLAEDAKLQLSKDTYDDDLDNLLAQIGDQYADLFLAAKNLSDAILLSDILRVNS

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGAYHDLLKIIKDKDFLDNEENEDILEDIV

LTLTLFEDRGMIEERLKTYAHLFDDKVMKQLKRRRYTGWGRLSRKLINGIRDKQSGKTILDF

LKSDGFANRNFMQLIHDDSLTFKEDIQKAQVSGQG<u>HSLHEQIANLAGSPAIKKGILQTVKIV</u>

<u>DELVKVMGHKPENIVIEMARE</u>NQTTQKGQKNSRERMKRIEEGIKELGSQILKEHPVENTQLQ

NEKLYLYYLQNGRDMYVDQELDINRLSDYDVDHIVPQSFIKDDSIDNKVLTRSDKNRGKSDN

VPSEEVVKKMKNYWRQLLNAKLITQRKFDNLTKAER<u>GGLSELDKAGFIKRQLVETRQITKHV</u>

<u>AQILDSRMNTKYDENDKLIREVKVITLKSKLVSDFRKDFQFYKVREINNYHHAHDAYLNAVV</u>

<u>GTALIKKYPKLESEFVYGDYKVYDVRKMIAKSEQEIGKATAKYFFYSNIMNFFKTEITLANG</u>

<u>EIRKRPLIETNGETGEIVWDKGRDFATVRKVLSMPQVNIVKKTEVQT</u>GGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD
(single underline: HNH domain; double underline: RuvC domain)

In some embodiments, wild type Cas9 corresponds to, or 50
comprises the following nucleotide and/or amino acid
sequences:

ATGGATAAAAAGTATTCTATTGGTTTAGACATCGGCACTAATTCCGTTGGATGGGCTGTCAT

AACCGATGAATACAAAGTACCTTCAAAGAAATTTAAGGTGTTGGGGAACACAGACCGTCATT

CGATTAAAAAGAATCTTATCGGTGCCCTCCTATTCGATAGTGGCGAAACGGCAGAGGCGACT

CGCCTGAAACGAACCGCTCGGAGAAGGTATACACGTCGCAAGAACCGAATATGTTACTTACA

AGAAATTTTTAGCAATGAGATGGCCAAAGTTGACGATTCTTTCTTTCACCGTTTGGAAGAGT

CCTTCCTTGTCGAAGAGGACAAGAAACATGAACGGCACCCCATCTTTGGAAACATAGTAGAT

GAGGTGGCATATCATGAAAGTACCCAACGATTTATCACCTCAGAAAAAAGCTAGTTGACTC

AACTGATAAAGCGGACCTGAGGTTAATCTACTTGGCTCTTGCCCATATGATAAAGTTCCGTG

-continued

GGCACTTTCTCATTGAGGGTGATCTAAATCCGGACAACTCGGATGTCGACAAACTGTTCATC

CAGTTAGTACAAACCTATAATCAGTTGTTTGAAGAGAACCCTATAAATGCAAGTGGCGTGGA

TGCGAAGGCTATTCTTAGCGCCCGCCTCTCTAAATCCCGACGGCTAGAAAACCTGATCGCAC

AATTACCCGGAGAGAAGAAAAATGGGTTGTTCGGTAACCTTATAGCGCTCTCACTAGGCCTG

ACACCAAATTTTAAGTCGAACTTCGACTTAGCTGAAGATGCCAAATTGCAGCTTAGTAAGGA

CACGTACGATGACGATCTCGACAATCTACTGGCACAAATTGGAGATCAGTATGCGGACTTAT

TTTTGGCTGCCAAAAACCTTAGCGATGCAATCCTCCTATCTGACATACTGAGAGTTAATACT

GAGATTACCAAGGCGCCGTTATCCGCTTCAATGATCAAAAGGTACGATGAACATCACCAAGA

CTTGACACTTCTCAAGGCCCTAGTCCGTCAGCAACTGCCTGAGAAATATAAGGAAATATTCT

TTGATCAGTCGAAAAACGGGTACGCAGGTTATATTGACGGCGGAGCGAGTCAAGAGGAATTC

TACAAGTTTATCAAACCCATATTAGAGAAGATGGATGGGACGGAAGAGTTGCTTGTAAAACT

CAATCGCGAAGATCTACTGCGAAAGCAGCGGACTTTCGACAACGGTAGCATTCCACATCAAA

TCCACTTAGGCGAATTGCATGCTATACTTAGAAGGCAGGAGGATTTTTATCCGTTCCTCAAA

GACAATCGTGAAAAGATTGAGAAAATCCTAACCTTTCGCATACCTTACTATGTGGGACCCCT

GGCCCGAGGGAACTCTCGGTTCGCATGGATGACAAGAAAGTCCGAAGAAACGATTACTCCAT

GGAATTTTGAGGAAGTTGTCGATAAAGGTGCGTCAGCTCAATCGTTCATCGAGAGGATGACC

AACTTTGACAAGAATTTACCGAACGAAAAAGTATTGCCTAAGCACAGTTTACTTTACGAGTA

TTTCACAGTGTACAATGAACTCACGAAAGTTAAGTATGTCACTGAGGGCATGCGTAAACCCG

CCTTTCTAAGCGGAGAACAGAAGAAAGCAATAGTAGATCTGTTATTCAAGACCAACCGCAAA

GTGACAGTTAAGCAATTGAAAGAGGACTACTTTAAGAAAATTGAATGCTTCGATTCTGTCGA

GATCTCCGGGGTAGAAGATCGATTTAATGCGTCACTTGGTACGTATCATGACCTCCTAAAGA

TAATTAAAGATAAGGACTTCCTGGATAACGAAGAGAATGAAGATATCTTAGAAGATATAGTG

TTGACTCTTACCCTCTTTGAAGATCGGGAAATGATTGAGGAAAGACTAAAAACATACGCTCA

CCTGTTCGACGATAAGGTTATGAAACAGTTAAAGAGGCGTCGCTATACGGGCTGGGGACGAT

TGTCGCGGAAACTTATCAACGGGATAAGAGACAAGCAAAGTGGTAAAACTATTCTCGATTTT

CTAAAGAGCGACGGCTTCGCCAATAGGAACTTTATGCAGCTGATCCATGATGACTCTTTAAC

CTTCAAAGAGGATATACAAAAGGCACAGGTTTCCGGACAAGGGGACTCATTGCACGAACATA

TTGCGAATCTTGCTGGTTCGCCAGCCATCAAAAAGGGCATACTCCAGACAGTCAAAGTAGTG

GATGAGCTAGTTAAGGTCATGGGACGTCACAAACCGGAAAACATTGTAATCGAGATGGCACG

CGAAAATCAAACGACTCAGAAGGGGCAAAAAAACAGTCGAGAGCGGATGAAGAGAATAGAAG

AGGGTATTAAAGAACTGGGCAGCCAGATCTTAAAGGAGCATCCTGTGGAAAATACCCAATTG

CAGAACGAGAAACTTTACCTCTATTACCTACAAAATGGAAGGGACATGTATGTTGATCAGGA

ACTGGACATAAACCGTTTATCTGATTACGACGTCGATCACATTGTACCCCAATCCTTTTTGA

AGGACGATTCAATCGACAATAAAGTGCTTACACGCTCGGATAAGAACCGAGGGAAAAGTGAC

AATGTTCCAAGCGAGGAAGTCGTAAAGAAAATGAAGAACTATTGGCGGCAGCTCCTAAATGC

GAAACTGATAACGCAAAGAAAGTTCGATAACTTAACTAAAGCTGAGAGGGGTGGCTTGTCTG

AACTTGACAAGGCCGGATTTATTAAAACGTCAGCTCGTGGAAACCCGCCAAATCACAAAGCAT

GTTGCACAGATACTAGATTCCCGAATGAATACGAAATACGACGAGAACGATAAGCTGATTCG

GGAAGTCAAAGTAATCACTTTAAAGTCAAAATTGGTGTCGGACTTCAGAAAGGATTTTCAAT

TCTATAAAGTTAGGGAGATAAATAACTACCACCATGCGCACGACGCTTATCTTAATGCCGTC

-continued

```
GTAGGGACCGCACTCATTAAGAAATACCCGAAGCTAGAAAGTGAGTTTGTGTATGGTGATTA

CAAAGTTTATGACGTCCGTAAGATGATCGCGAAAAGCGAACAGGAGATAGGCAAGGCTACAG

CCAAATACTTCTTTTATTCTAACATTATGAATTTCTTTAAGACGGAAATCACTCTGGCAAAC

GGAGAGATACGCAAACGACCTTTAATTGAAACCAATGGGGAGACAGGTGAAATCGTATGGGA

TAAGGGCCGGGACTTCGCGACGGTGAGAAAAGTTTTGTCCATGCCCCAAGTCAACATAGTAA

AGAAACTGAGGTGCAGACCGGAGGGTTTTCAAAGGAATCGATTCTTCCAAAAAGGAATAGT

GATAAGCTCATCGCTCGTAAAAAGGACTGGGACCCGAAAAAGTACGGTGGCTTCGATAGCCC

TACAGTTGCCTATTCTGTCCTAGTAGTGGCAAAAGTTGAGAAGGGAAAATCCAAGAAACTGA

AGTCAGTCAAAGAATTATTGGGGATAACGATTATGGAGCGCTCGTCTTTTGAAAAGAACCCC

ATCGACTTCCTTGAGGCGAAAGGTTACAAGGAAGTAAAAAAGGATCTCATAATTAAACTACC

AAAGTATAGTCTGTTTGAGTTAGAAAATGGCCGAAAACGGATGTTGGCTAGCGCCGGAGAGC

TTCAAAAGGGGAACGAACTCGCACTACCGTCTAAATACGTGAATTTCCTGTATTTAGCGTCC

CATTACGAGAAGTTGAAAGGTTCACCTGAAGATAACGAACAGAAGCAACTTTTTGTTGAGCA

GCACAAACATTATCTCGACGAAATCATAGAGCAAATTTCGGAATTCAGTAAGAGAGTCATCC

TAGCTGATGCCAATCTGGACAAAGTATTAAGCGCATACAACAAGCACAGGGATAAACCCATA

CGTGAGCAGGCGGAAAATATTATCCATTTGTTTACTCTTACCAACCTCGGCGCTCCAGCCGC

ATTCAAGTATTTTGACACAACGATAGATCGCAAACGATACACTTCTACCAAGGAGGTGCTAG

ACGCGACACTGATTCACCAATCCATCACGGGATTATATGAAACTCGGATAGATTTGTCACAG

CTTGGGGGTGACGGATCCCCCAAGAAGAAGAGGAAAGTCTCGAGCGACTACAAAGACCATGA

CGGTGATTATAAAGATCATGACATCGATTACAAGGATGACGATGACAAGGCTGCAGGA

MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

ElTKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIEINGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP
```

-continued

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (single underline: BINH domain; double underline: RuvC domain)

In some embodiments, wild type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows).

ATGGATAAGAAATACTCAATAGGCTTAGATATCGGCACAAATAGCGTCGGATGGGCGGTGAT

CACTGATGAATATAAGGTTCCGTCTAAAAAGTTCAAGGTTCTGGGAAATACAGACCGCCACA

GTATCAAAAAAAATCTTATAGGGGCTCTTTTATTTGACAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGTAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAACCTACAATCAATTATTTGAAGAAAACCCTATTAACGCAAGTGGAGTAGA

TGCTAAAGCGATTCTTTCTGCACGATTGAGTAAATCAAGACGATTAGAAAATCTCATTGCTC

AGCTCCCCGGTGAGAAGAAAAATGGCTTATTTGGGAATCTCATTGCTTTGTCATTGGGTTTG

ACCCCTAATTTTAAATCAAATTTTGATTTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATACT

GAAATAACTAAGGCTCCCCTATCAGCTTCAATGATTAAACGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAAGTACTACCAAAACATAGTTTGCTTTATGAGTA

TTTTACGGTTTATAACGAATTGACAAAGGTCAAATATGTTACTGAAGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGTACCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGGAGATGATTGAGGAAAGACTTAAAACATATGCTCA

-continued

```
CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGACATTCAAAAAGCACAAGTGTCTGGACAAGGCGATAGTTTACATGAACATA

TTGCAAATTTAGCTGGTAGCCCTGCTATTAAAAAAGGTATTTTACAGACTGTAAAAGTTGTT

GATGAATTGGTCAAAGTAATGGGGCGGCATAAGCCAGAAAATATCGTTATTGAAATGGCACG

TGAAAATCAGACAACTCAAAAGGGCCAGAAAAATTCGCGAGAGCGTATGAAACGAATCGAAG

AAGGTATCAAAGAATTAGGAAGTCAGATTCTTAAAGAGCATCCTGTTGAAAATACTCAATTG

CAAAATGAAAAGCTCTATCTCTATTATCTCCAAAATGGAAGAGACATGTATGTGGACCAAGA

ATTAGATATTAATCGTTTAAGTGATTATGATGTCGATCACATTGTTCCACAAAGTTTCCTTA

AAGACGATTCAATAGACAATAAGGTCTTAACGCGTTCTGATAAAAATCGTGGTAAATCGGAT

AACGTTCCAAGTGAAGAAGTAGTCAAAAAGATGAAAAACTATTGGAGACAACTTCTAAACGC

CAAGTTAATCACTCAACGTAAGTTTGATAATTTAACGAAAGCTGAACGTGGAGGTTTGAGTG

AACTTGATAAAGCTGGTTTTATCAAACGCCAATTGGTTGAAACTCGCCAAATCACTAAGCAT

GTGGCACAAATTTTGGATAGTCGCATGAATACTAAATACGATGAAAATGATAAACTTATTCG

AGAGGTTAAAGTGATTACCTTAAAATCTAAATTAGTTTCTGACTTCCGAAAAGATTTCCAAT

TCTATAAAGTACGTGAGATTAACAATTACCATCATGCCCATGATGCGTATCTAAATGCCGTC

GTTGGAACTGCTTTGATTAAGAAATATCCAAAACTTGAATCGGAGTTTGTCTATGGTGATTA

TAAAGTTTATGATGTTCGTAAAATGATTGCTAAGTCTGAGCAAGAAATAGGCAAAGCAACCG

CAAAATATTTCTTTTACTCTAATATCATGAACTTCTTCAAAACAGAAATTACACTTGCAAAT

GGAGAGATTCGCAAACGCCCTCTAATCGAAACTAATGGGGAAACTGGAGAAATTGTCTGGGA

TAAAGGGCGAGATTTTGCCACAGTGCGCAAAGTATTGTCCATGCCCCAAGTCAATATTGTCA

AGAAAACAGAAGTACAGACAGGCGGATTCTCCAAGGAGTCAATTTTACCAAAAAGAAATTCG

GACAAGCTTATTGCTCGTAAAAAAGACTGGGATCCAAAAAAATATGGTGGTTTTGATAGTCC

AACGGTAGCTTATTCAGTCCTAGTGGTTGCTAAGGTGGAAAAAGGGAAATCGAAGAAGTTAA

AATCCGTTAAAGAGTTACTAGGGATCACAATTATGGAAGAAGTTCCTTTGAAAAAAATCCG

ATTGACTTTTTAGAAGCTAAAGGATATAAGGAAGTTAAAAAAGACTTAATCATTAAACTACC

TAAATATAGTCTTTTTGAGTTAGAAAACGGTCGTAAACGGATGCTGGCTAGTGCCGGAGAAT

TACAAAAAGGAAATGAGCTGGCTCTGCCAAGCAAATATGTGAATTTTTTATATTTAGCTAGT

CATTATGAAAAGTTGAAGGGTAGTCCAGAAGATAACGAACAAAAACAATTGTTTGTGGAGCA

GCATAAGCATTATTTAGATGAGATTATTGAGCAAATCAGTGAATTTTCTAAGCGTGTTATTT

TAGCAGATGCCAATTTAGATAAAGTTCTTAGTGCATATAACAAACATAGAGACAAACCAATA

CGTGAACAAGCAGAAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAG

ATGCCACTCTTATCCATCAATCCATCACTGGTCTTTATGAAACACGCATTGATTTGAGTCAG

CTAGGAGGTGACTGA

MDKKYSIGLDIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT
```

-continued

```
EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
```

(SEQ ID NO: 1. single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); Spiroplasma syrphidicola (NCBI Ref: NC_021284.1); *Prevotella intermedia* (NCBI Ref: NC_017861.1); Spiroplasma *taiwanense* (NCBI Ref: NC_021846.1); *Streptococcus* iniae (NCBI Ref: NC_021314.1); Belliella *baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1),

*Campylobacter jejuni* (NCBI Ref: YP_002344900.1) or *Neisseria. meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9. In some embodiments, the dCas9 comprises the amino acid sequence of dCas9 (D10A and H840A):

```
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL
```

-continued

```
QNEKLYLYYLQNGRDMYVDQELDINRLSDYDVDAIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEIILAN

GEIRKRPLIEINGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
(single underline: BINH domain; double underline: RuvC domain).
```

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); Spiroplasma syrphidicola (NCBI Ref: NC_021284.1); 10 *Prevotella intermedia* (NCBI Ref: NC_017861.1); Spiroplasma *taiwanense* (NCBI Ref: NC_021846.1); *Streptococcus* iniae (NCBI Ref: NC_021314.1); Belliella *baltica* (NCBI Ref: NC_018010.1); *Psychroflexus torquisI* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

```
Exemplary catalytically inactive Cas9 (dCas9)
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFI

ARLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHTIQDLTLLKALVRQQ

LPEKYKEIFFDQSKNGYAGYIDGGASQEEFYKFIKPILEKMDGTEELLV

KLNREDLLRKQRTFDNGSIPHQIHLGELHAILRRQEDFYPFLKDNREKI

EKILTFRIPYYVGPLARGNSRFAWMTRKSEETITPWNFEEVVDKGASAQ

SFIERMTNFDKNLPNEKVLPKHSLLYEYFTVYNELTKVKYVTEGMRKPA

FLSGEQKKAIVDLLFKTNRKVTVKQLKEDYFKKIECFDSVEISGVEDRF

NASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKS

DGFANRNFMQLIHDDSLTFKEDIQKAQVSGQGDSLHEHIANLAGSPAIK

KGILQTVKVVDELVKVMGRHKPENIVIEMARENQTTQKGQKNSRERMKR

IEEGIKELGSQILKEHPVENTQLQNEKLYLYYLQNGRDMYVDQELDINR

LSDYDVDAIVPQSFLKDDSIDNKVLTRSDKNRGKSDNVPSEEVVKKMKN

YWRQLLNAKLITQRKFDNLTKAERGGLSELDKAGFIKRQLVETRQITKH

VAQILDSRMNTKYDENDKLIREVKVITLKSKLVSDFRKDFQFYKVREIN

NYHHAHDAYLNAVVGTALIKKYPKLESEFVYGDYKVYDVRKMIAKSEQE

IGKATAKYFFYSNIMNFFKTEITLANGEIRKRPLIETNGETGEIVWDKG
```

-continued

RDFATVRKVLSMPQVNIVKKTEVQTGGFSKESILPKRNSDKLIARKKDW

DPKKYGGFDSPTVAYSVLVVAKVEKGKSKKLKSVKELLGITIMERSSFE

KNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQI

SEFSKRVILADANLDKVLSAYNKEIRDKPIREQAENIIHLFTLTNLGAP

AAFKYFDTTIDRKRYTSTKEVLDATLIHQSITGLYETRIDLSQLGGD

Exemplary catalytically Cas9 nickase (nCas9):
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLEIEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD

Exemplary catalytically active Cas9:
DKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

-continued

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKHKPILEKMDGTEELLVKLN

REDLLRKQRTFDNGSIPHQIHLGELHAILRRQEDFYPFLKDNREKIEKI

LTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNAS

LGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGF

ANRNFMQLIHDDSLTFKEDIQKAQVSGQGDSLHEHIANLAGSPAIKKGI

LQTVKVVDELVKVMGRHKPENIVIEMARENQTTQKGQKNSRERMKRIEE

GIKELGSQILKEHPVENTQLQNEKLYLYYLQNGRDMYVDQELDINRLSD

YDVDHIVPQSFLKDDSIDNKVLTRSDKNRGKSDNVPSEEVVKKMKNYWR

QLLNAKLITQRKFDNLTKAERGGLSELDKAGFIKRQLVETRQITKHVAQ

ILDSRMNTKYDENDKLIREVKVITLKSKLVSDFRKDFQFYKVREINNYH

HAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNP

IDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEF

SKRVILADANLDKVLSAYNKEIRDKPIREQAENIIHLFTLTNLGAPAAF

KYFDTTIDRKRYTSTKEVLDATLIHQSITGLYETRIDLSQLGGD.

In some embodiments, Cas9 refers to a Cas9 from archaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napD-NAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

```
CasX (uniprot.org/uniprot/F0NN87; uniprot.org/
uniprot/F0NH53)
>tr|F0NN87|F0NN87_SULIH CRISPR-associated Casx
protein OS = Sulfolobus islandicus (strain HVE10/4)
GN = SiH_0402 PE = 4 SV = 1
MEVPLYNIFGDNYIIQVATEAENSTIYNNKVEIDDEELRNVLNLAYKIA

KNNEDAAAERRGKAKKKKGEEGETTTSNIILPLSGNDKNPWTETLKCYN

FPTTVALSEVFKNFSQVKECEEVSAPSFVKPEFYEFGRSPGMVERTRRV

KLEVEPHYLIIAAAGWVLTRLGKAKVSEGDYVGVNVFTPTRGILYSLIQ

NVNGIVPGIKPETAFGLWIARKVVSSVTNPNVSVVRIYTISDAVGQNPT

TINGGFSIDLTKLLEKRYLLSERLEAIARNALSISSNMRERYIVLANYI

YEYLTGSKRLEDLLYFANRDLIMNLNSDDGKVRDLKLISAYVNGEHRGE

G

>tr|F0NH53|F0NH53_SULIR CRISPR associated protein,
Casx OS = Sulfolobus islandicus (strain REY15A)
GN = SiRe_0771 PE = 4 SV = 1
MEVPLYNIFGDNYIIQVATEAENSTIYNNKVEIDDEELRNVLNLAYKIA

KNNEDAAAERRGKAKKKKGEEGETTTSNIILPLSGNDKNPWTETLKCYN

FPTTVALSEVFKNFSQVKECEEVSAPSFVKPEFYKFGRSPGMVERTRRV

KLEVEPHYLIMAAAGWVLTRLGKAKVSEGDYVGVNVFTPTRGILYSLIQ

NVNGIVPGIKPETAFGLWIARKVVSSVTNPNVSVVSIYTISDAVGQNPT

TINGGFSIDLTKLLEKRDLLSERLEAIARNALSISSNMRERYIVLANYI

YEYLTGSKRLEDLLYFANRDLIMNLNSDDGKVRDLKLISAYVNGELIRG

EG

CasY (ncbi.nlm.nih.gov/protein/APG80656.1)
>APG80656.1 CRISPR-associated protein CasY
[uncultured Parcubacteria group bacterium]
MSKRHPRISGVKGYRLHAQRLEYTGKSGAMRTIKYPLYSSPSGGRTVPR

EIVSAINDDYVGLYGLSNFDDLYNAEKRNEEKVYSVLDFWYDCVQYGAV
```

```
-continued
FSYTAPGLLKNVAEVRGGSYELTKTLKGSHLYDELQIDKVIKFLNKKEI

SRANGSLDKLKKDIIDCFKAEYRERHKDQCNKLADDIKNAKKDAGASLG

ERQKKLFRDFFGISEQSENDKPSFTNPLNLTCCLLPFDTVNNNRNRGEV

LFNKLKEYAQKLDKNEGSLEMVVEYIGIGNSGTAFSNFLGEGFLGRLRE

NKITELKKAMMDITDAWRGQEQEEELEKRLRILAALTIKLREPKFDNHW

GGYRSDINGKLSSWLQNYINQTVKIKEDLKGHKKDLKKAKEMINRFGES

DTKEEAVVSSLLESIEKIVPDDSADDEKPDIPAIAIYRRFLSDGRLTLN

RFVQREDVQEALIKERLEAEKKKKPKKRKKKSDAEDEKETIDFKELFPH

LAKPLKLVPNFYGDSKRELYKKYKNAAIYTDALWKAVEKIYKSAFSSSL

KNSFFDTDFDKDFFIKRLQKIFSVYRRFNTDKWKPIVKNSFAPYCDIVS

LAENEVLYKPKQSRSRKSAAIDKNRVRLPSTENIAKAGIALARELSVAG

FDWKDLLKKEEHEEVIDLIELHKTALALLLAVTETQLDISALDFVENGT

VKDFMKTRDGNLVLEGRFLEMFSQSIVFSELRGLAGLMSRKEFITRSAI

QTMNGKQAELLYIPHEFQSAKITTPKEMSRAFLDLAPAEFATSLEPESL

SEKSLLKLKQMRYYPHYFGYELTRTGQGIDGGVAENALRLEKSPVKKRE

IKCKQYKTLGRGQNKIVLYVRSSYYQTQFLEWFLHRPKNVQTDVAVSGS

FLIDEKKVKTRWNYDALTVALEPVSGSERVFVSQPFTIFPPEKSAEEEGQ

RYLGIDIGEYGIAYTALEITGDSAKILDQNFISDPQLKTLREEVKGLKL

DQRRGTFAMPSTKIARIRESLVHSLRNRIKEILALKHKAKIVVELEVSR

FEEGKQKIKKVYATLKKADVYSEIDADKNLQTTVWGKLAVASEISASYT

SQFCGACKKLWRAEMQVDETITTQELIGTVRVIKGGTLIDAIKDFMRPP

IFDENDTPFPKYRDFCDKHHISKKMRGNSCLFICPFCRANADADIQASQ

TIALLRYVKEEKKVEDYFERFRKLKNIKVLGQMKKI
```

By "cytidine deaminase" is meant a polypeptide or fragment thereof capable of catalyzing a deamination reaction that converts an amino group to a carbonyl group. In one embodiment, the cytidine deaminase converts cytosine to uracil or 5-methylcytosine to thymine. PmCDA1, which is derived from *Petromyzon marinus* (*Petromyzon marinus* cytosine deaminase 1, "PmCDA1"), AID (Activation-induced cytidine deaminase; AICDA), which is derived from a mammal (e.g., human, swine, bovine, horse, monkey etc.), and APOBEC are exemplary cytidine deaminases.

The base sequence and amino acid sequence of PmCDA1 and the base sequence and amino acid sequence of CDS of human AID are shown herein below:

```
>tr|A5H718|A5H718_PETMA Cytosine deaminase OS = Petromyzon marinus
OX = 7757 PE = 2 SV = 1
MTDAEYVRIHEKLDIYTFKKQFFNNKKSVSHRCYVLFELKRRGERRACFWGYAVNKPQSGTERGIHAEIF

SIRKVEEYLRDNPGQFTINWYSSWSPCADCAEKILEWYNQELRGNGHTLKIWACKLYYEKNARNQIGLWN

LRDNGVGLNVMVSEHYQCCRKIFIQSSHNQLNENRWLEKTLKRAEKRRSELSIMIQVKILHTTKSPAV

>EF094822.1 Petromyzon marinus isolate PmCDA.21 cytosine deaminase
mRNA, complete cds
TGACACGACACAGCCGTGTATATGAGGAAGGGTAGCTGGATGGGGGGGGGGGGAATACGTTCAGAGAGGA

CATTAGCGAGCGTCTTGTTGGTGGCCTTGAGTCTAGACACCTGCAGACATGACCGACGCTGAGTACGTGA

GAATCCATGAGAAGTTGGACATCTACACGTTTAAGAAACAGTTTTTCAACAACAAAAAATCCGTGTCGCA
```

-continued

```
TAGATGCTACGTTCTCTTTGAATTAAAACGACGGGGTGAACGTAGAGCGTGTTTTTGGGGCTATGCTGTG

AATAAACCACAGAGCGGGACAGAACGTGGAATTCACGCCGAAATCTTTAGCATTAGAAAAGTCGAAGAAT

ACCTGCGCGACAACCCCGGACAATTCACGATAAATTGGTACTCATCCTGGAGTCCTTGTGCAGATTGCGC

TGAAAAGATCTTAGAATGGTATAACCAGGAGCTGCGGGGGAACGGCCACACTTTGAAAATCTGGGCTTGC

AAACTCTATTACGAGAAAAATGCGAGGAATCAAATTGGGCTGTGGAACCTCAGAGATAACGGGGTTGGGT

TGAATGTAATGGTAAGTGAACACTACCAATGTTGCAGGAAAATATTCATCCAATCGTCGCACAATCAATT

GAATGAGAATAGATGGCTTGAGAAGACTTTGAAGCGAGCTGAAAAACGACGGAGCGAGTTGTCCATTATG

ATTCAGGTAAAAATACTCCACACCACTAAGAGTCCTGCTGTTTAAGAGGCTATGCGGATGGTTTTC
```

>tr|Q6QJ80|Q6QJ80_HUMAN Activation-induced cytidine deaminase
OS = *Homo sapiens* OX = 9606 GN = AICDA PE = 2 SV = 1
```
MDSLLMNRRKFLYQFKNVRWAKGRRETYLCYVVKRRDSATSFSLDFGYLRNKNGCHVELLFLRYISDWDL

DPGRCYRVTWFTSWSPCYDCARHVADFLRGNPNLSLRIFTARLYFCEDRKAEPEGLRRLHRAGVQIAIMT

FKAPV
```

>NG_011588.1:5001-15681 *Homo sapiens* activation induced cytidine
deaminase (AICDA), RefSeqGene (LRG_17) on chromosome 12
```
AGAGAACCATCATTAATTGAAGTGAGATTTTTCTGGCCTGAGACTTGCAGGGAGGCAAGAAGACACTCTG

GACACCACTATGGACAGGTAAAGAGGCAGTCTTCTCGTGGGTGATTGCACTGGCCTTCCTCTCAGAGCAA

ATCTGAGTAATGAGACTGGTAGCTATCCCTTTCTCTCATGTAACTGTCTGACTGATAAGATCAGCTTGAT

CAATATGCATATATATTTTTGATCTGTCTCCTTTTCTTCTATTCAGATCTTATACGCTGTCAGCCCAAT

TCTTTCTGTTTCAGACTTCTCTTGATTTCCCTCTTTTTCATGTGGCAAAAGAAGTAGTGCGTACAATGTA

CTGATTCGTCCTGAGATTTGTACCATGGTTGAAACTAATTTATGGTAATAATATTAACATAGCAAATCTT

TAGAGACTCAAATCATGAAAAGGTAATAGCAGTACTGTACTAAAAACGGTAGTGCTAATTTTCGTAATAA

TTTTGTAAATATTCAACAGTAAAACAACTTGAAGACACACTTTCCTAGGGAGGCGTTACTGAAATAATTT

AGCTATAGTAAGAAAATTTGTAATTTTAGAAATGCCAAGCATTCTAAATTAATTGCTTGAAAGTCACTAT

GATTGTGTCCATTATAAGGAGACAAATTCATTCAAGCAAGTTATTTAATGTTAAAGGCCCAATTGTTAGG

CAGTTAATGGCACTTTTACTATTAACTAATCTTTCCATTTGTTCAGACGTAGCTTAACTTACCTCTTAGG

TGTGAATTTGGTTAAGGTCCTCATAATGTCTTTATGTGCAGTTTTTGATAGGTTATTGTCATAGAACTTA

TTCTATTCCTACATTTATGATTACTATGGATGTATGAGAATAACACCTAATCCTTATACTTTACCTCAAT

TTAACTCCTTTATAAAGAACTTACATTACAGAATAAAGATTTTTTAAAAATATATTTTTTTGTAGAGACA

GGGTCTTAGCCCAGCCGAGGCTGGTCTCTAAGTCCTGGCCCAAGCGATCCTCCTGCCTGGGCCTCCTAAA

GTGCTGGAATTATAGACATGAGCCATCACATCCAATATACAGAATAAAGATTTTTAATGGAGGATTTAAT

GTTCTTCAGAAAATTTTCTTGAGGTCAGACAATGTCAAATGTCTCCTCAGTTTACACTGAGATTTTGAAA

ACAAGTCTGAGCTATAGGTCCTTGTGAAGGGTCCATTGGAAATACTTGTTCAAAGTAAAATGGAAAGCAA

AGGTAAAATCAGCAGTTGAAATTCAGAGAAAGACAGAAAAGGAGAAAAGATGAAATTCAACAGGACAGAA

GGGAAATATATTATCATTAAGGAGGACAGTATCTGTAGAGCTCATTAGTGATGGCAAAATGACTTGGTCA

GGATTATTTTTAACCCGCTTGTTTCTGGTTTGCACGGCTGGGGATGCAGCTAGGGTTCTGCCTCAGGGAG

CACAGCTGTCCAGAGCAGCTGTCAGCCTGCAAGCCTGAAACACTCCCTCGGTAAAGTCCTTCCTACTCAG

GACAGAAATGACGAGAACAGGGAGCTGGAAACAGGCCCCTAACCAGAGAAGGGAAGTAATGGATCAACAA

AGTTAACTAGCAGGTCAGGATCACGCAATTCATTTCACTCTGACTGGTAACATGTGACAGAAACAGTGTA

GGCTTATTGTATTTTCATGTAGAGTAGGACCCAAAAATCCACCCAAAGTCCTTTATCTATGCCACATCCT

TCTTATCTATACTTCCAGGACACTTTTTCTTCCTTATGATAAGGCTCTCTCTCTCTCCACACACACAC

ACACACACACACACACACACACACACAAACACACACCCCGCCAACCAAGGTGCATGTAAAAGA

TGTAGATTCCTCTGCCTTTCTCATCTACACAGCCCAGGAGGGTAAGTTAATATAAGAGGGATTTATTGGT
```

-continued

```
AAGAGATGATGCTTAATCTGTTTAACACTGGGCCTCAAAGAGAGAATTTCTTTTCTTCTGTACTTATTAA

GCACCTATTATGTGTTGAGCTTATATATACAAAGGGTTATTATATGCTAATATAGTAATAGTAATGGTGG

TTGGTACTATGGTAATTACCATAAAAATTATTATCCTTTTAAAATAAAGCTAATTATTATTGGATCTTTT

TTAGTATTCATTTTATGTTTTTTATGTTTTTGATTTTTTAAAAGACAATCTCACCCTGTTACCCAGGCTG

GAGTGCAGTGGTGCAATCATAGCTTTCTGCAGTCTTGAACTCCTGGGCTCAAGCAATCCTCCTGCCTTGG

CCTCCCAAAGTGTTGGGATACAGTCATGAGCCACTGCATCTGGCCTAGGATCCATTTAGATTAAAATATG

CATTTTAAATTTTAAAATAATATGGCTAATTTTTACCTTATGTAATGTGTATACTGGCAATAAATCTAGT

TTGCTGCCTAAAGTTTAAAGTGCTTTCCAGTAAGCTTCATGTACGTGAGGGGAGACATTTAAAGTGAAAC

AGACAGCCAGGTGTGGTGGCTCACGCCTGTAATCCCAGCACTCTGGGAGGCTGAGGTGGGTGGATCGCTT

GAGCCCTGGAGTTCAAGACCAGCCTGAGCAACATGGCAAAACGCTGTTTCTATAACAAAAATTAGCCGGG

CATGGTGGCATGTGCCTGTGGTCCCAGCTACTAGGGGGCTGAGGCAGGAGAATCGTTGGAGCCCAGGAGG

TCAAGGCTGCACTGAGCAGTGCTTGCGCCACTGCACTCCAGCCTGGGTGACAGGACCAGACCTTGCCTCA

AAAAAATAAGAAGAAAAATTAAAAATAAATGGAAACAACTACAAAGAGCTGTTGTCCTAGATGAGCTACT

TAGTTAGGCTGATATTTTGGTATTTAACTTTTAAAGTCAGGGTCTGTCACCTGCACTACATTATTAAAAT

ATCAATTCTCAATGTATATCCACACAAAGACTGGTACGTGAATGTTCATAGTACCTTTATTCACAAAACC

CCAAAGTAGAGACTATCCAAATATCCATCAACAAGTGAACAAATAAACAAAATGTGCTATATCCATGCAA

TGGAATACCACCCTGCAGTACAAAGAAGCTACTTGGGGATGAATCCCAAAGTCATGACGCTAAATGAAAG

AGTCAGACATGAAGGAGGAGATAATGTATGCCATACGAAATTCTAGAAAATGAAAGTAACTTATAGTTAC

AGAAAGCAAATCAGGGCAGGCATAGAGGCTCACACCTGTAATCCCAGCACTTTGAGAGGCCACGTGGGAA

GATTGCTAGAACTCAGGAGTTCAAGACCAGCCTGGGCAACACAGTGAAACTCCATTCTCCACAAAAATGG

GAAAAAAAGAAAGCAAATCAGTGGTTGTCCTGTGGGGAGGGGAAGGACTGCAAAGAGGGAAGAAGCTCTG

GTGGGGTGAGGGTGGTGATTCAGGTTCTGTATCCTGACTGTGGTAGCAGTTTGGGGTGTTTACATCCAAA

AATATTCGTAGAATTATGCATCTTAAATGGGTGGAGTTTACTGTATGTAAATTATACCTCAATGTAAGAA

AAAATAATGTGTAAGAAAACTTTCAATTCTCTTGCCAGCAAACGTTATTCAAATTCCTGAGCCCTTTACT

TCGCAAATTCTCTGCACTTCTGCCCCGTACCATTAGGTGACAGCACTAGCTCCACAAATTGGATAAATGC

ATTTCTGGAAAAGACTAGGGACAAAATCCAGGCATCACTTGTGCTTTCATATCAACCATGCTGTACAGCT

TGTGTTGCTGTCTGCAGCTGCAATGGGGACTCTTGATTTCTTTAAGGAAACTTGGGTTACCAGAGTATTT

CCACAAATGCTATTCAAATTAGTGCTTATGATATGCAAGACACTGTGCTAGGAGCCAGAAAACAAAGAGG

AGGAGAAATCAGTCATTATGTGGGAACAACATAGCAAGATATTTAGATCATTTTGACTAGTTAAAAAAGC

AGCAGAGTACAAAATCACACATGCAATCAGTATAATCCAAATCATGTAAATATGTGCCTGTAGAAAGACT

AGAGGAATAAACACAAGAATCTTAACAGTCATTGTCATTAGCACTAAGTCTAATTATTATTATTAGACA

CTATGATATTTGAGATTTAAAAAATCTTTAATATTTTAAAATTTAGAGCTCTTCTATTTTTCCATAGTAT

TCAAGTTTGACAATGATCAAGTATTACTCTTTCTTTTTTTTTTTTTTTTTTTTTTTTGAGATGGAGTTT

TGGTCTTGTTGCCCATGCTGGAGTGGAATGGCATGACCATAGCTCACTGCAACCTCCACCTCCTGGGTTC

AAGCAAAGCTGTCGCCTCAGCCTCCCGGGTAGATGGGATTACAGGCGCCCACCACCACACTCGGCTAATG

TTTGTATTTTTAGTAGAGATGGGGTTTCACCATGTTGGCCAGGCTGGTCTCAAACTCCTGACCTCAGAGG

ATCCACCTGCCTCAGCCTCCCAAAGTGCTGGGATTACAGATGTAGGCCACTGCGCCCGGCCAAGTATTGC

TCTTATACATTAAAAAACAGGTGTGAGCCACTGCGCCCAGCCAGGTATTGCTCTTATACATTAAAAAATA

GGCCGGTGCAGTGGCTCACGCCTGTAATCCCAGCACTTTGGGAAGCCAAGGCGGGCAGAACACCCGAGGT

CAGGAGTCCAAGGCCAGCCTGGCCAAGATGGTGAAACCCCGTCTCTATTAAAAATACAAACATTACCTGG
```

```
GCATGATGGTGGGCGCCTGTAATCCCAGCTACTCAGGAGGCTGAGGCAGGAGGATCCGCGGAGCCTGGCA

GATCTGCCTGAGCCTGGGAGGTTGAGGCTACAGTAAGCCAAGATCATGCCAGTATACTTCAGCCTGGGCG

ACAAAGTGAGACCGTAACAAAAAAAAAAAAATTTAAAAAAAGAAATTTAGATCAAGATCCAACTGTAAAA

AGTGGCCTAAACACCACATTAAAGAGTTTGGAGTTTATTCTGCAGGCAGAAGAGAACCATCAGGGGGTCT

TCAGCATGGGAATGGCATGGTGCACCTGGTTTTTGTGAGATCATGGTGGTGACAGTGTGGGGAATGTTAT

TTTGGAGGGACTGGAGGCAGACAGACCGGTTAAAAGGCCAGCACAACAGATAAGGAGGAAGAAGATGAGG

GCTTGGACCGAAGCAGAGAAGAGCAAACAGGGAAGGTACAAATTCAAGAAATATTGGGGGGTTTGAATCA

ACACATTTAGATGATTAATTAAATATGAGGACTGAGGAATAAGAAATGAGTCAAGGATGGTTCCAGGCTG

CTAGGCTGCTTACCTGAGGTGGCAAAGTCGGGAGGAGTGGCAGTTTAGGACAGGGGGCAGTTGAGGAATA

TTGTTTTGATCATTTTGAGTTTGAGGTACAAGTTGGACACTTAGGTAAAGACTGGAGGGGAAATCTGAAT

ATACAATTATGGGACTGAGGAACAAGTTTATTTTATTTTTTGTTTCGTTTTCTTGTTGAAGAACAAATTT

AATTGTAATCCCAAGTCATCAGCATCTAGAAGACAGTGGCAGGAGGTGACTGTCTTGTGGGTAAGGGTTT

GGGGTCCTTGATGAGTATCTCTCAATTGGCCTTAAATATAAGCAGGAAAAGGAGTTTATGATGGATTCCA

GGCTCAGCAGGGCTCAGGAGGGCTCAGGCAGCCAGCAGAGGAAGTCAGAGCATCTTCTTTGGTTTAGCCC

AAGTAATGACTTCCTTAAAAAGCTGAAGGAAAATCCAGAGTGACCAGATTATAAACTGTACTCTTGCATT

TTCTCTCCCTCCTCTCACCCACAGCCTCTTGATGAACCGGAGGAAGTTTCTTTACCAATTCAAAAATGTC

CGCTGGGCTAAGGGTCGGCGTGAGACCTACCTGTGCTACGTAGTGAAGAGGCGTGACAGTGCTACATCCT

TTTCACTGGACTTTGGTTATCTTCGCAATAAGGTATCAATTAAAGTCGGCTTTGCAAGCAGTTTAATGGT

CAACTGTGAGTGCTTTTAGAGCCACCTGCTGATGGTATTACTTCCATCCTTTTTTGGCATTTGTGTCTCT

ATCACATTCCTCAAATCCTTTTTTTTTATTTCTTTTTCCATGTCCATGCACCCATATTAGACATGGCCCAA

AATATGTGATTTAATTCCTCCCCAGTAATGCTGGGCACCCTAATACCACTCCTTCCTTCAGTGCCAAGAA

CAACTGCTCCCAAACTGTTTACCAGCTTTCCTCAGCATCTGAATTGCCTTTGAGATTAATTAAGCTAAAA

GCATTTTTATATGGGAGAATATTATCAGCTTGTCCAAGCAAAAATTTTAAATGTGAAAAACAAATTGTGT

CTTAAGCATTTTTGAAAATTAAGGAAGAAGAATTTGGGAAAAAATTAACGGTGGCTCAATTCTGTCTTCC

AAATGATTTCTTTTCCCTCCTACTCACATGGGTCGTAGGCCAGTGAATACATTCAACATGGTGATCCCCA

GAAAACTCAGAGAAGCCTCGGCTGATGATTAATTAAATTGATCTTTCGGCTACCCGAGAGAATTACATTT

CCAAGAGACTTCTTCACCAAAATCCAGATGGGTTTACATAAACTTCTGCCCACGGGTATCTCCTCTCTCC

TAACACGCTGTGACGTCTGGGCTTGGTGGAATCTCAGGGAAGCATCCGTGGGGTGGAAGGTCATCGTCTG

GCTCGTTGTTTGATGGTTATATTACCATGCAATTTTCTTTGCCTACATTTGTATTGAATACATCCCAATC

TCCTTCCTATTCGGTGACATGACACATTCTATTTCAGAAGGCTTTGATTTTATCAAGCACTTTCATTTAC

TTCTCATGGCAGTGCCTATTACTTCTCTTACAATACCCATCTGTCTGCTTTACCAAAATCTATTTCCCCT

TTTCAGATCCTCCCAAATGGTCCTCATAAACTGTCCTGCCTCCACCTAGTGGTCCAGGTATATTTCCACA

ATGTTACATCAACAGGCACTTCTAGCCATTTTCCTTCTCAAAAGGTGCAAAAAGCAACTTCATAAACACA

AATTAAATCTTCGGTGAGGTAGTGTGATGCTGCTTCCTCCCAACTCAGCGCACTTCGTCTTCCTCATTCC

ACAAAAACCCATAGCCTTCCTTCACTCTGCAGGACTAGTGCTGCCAAGGGTTCAGCTCTACCTACTGGTG

TGCTCTTTTGAGCAAGTTGCTTAGCCTCTCTGTAACACAAGGACAATAGCTGCAAGCATCCCCAAAGATC

ATTGCAGGAGACAATGACTAAGGCTACCAGAGCCGCAATAAAAGTCAGTGAATTTTAGCGTGGTCCTCTC

TGTCTCTCCAGAACGGCTGCCACGTGGAATTGCTCTTCCTCCGCTACATCTCGGACTGGGACCTAGACCC

TGGCCGCTGCTACCGCGTCACCTGGTTCACCTCCTGGAGCCCCTGCTACGACTGTGCCCGACATGTGGCC

GACTTTCTGCGAGGGAACCCCAACCTCAGTCTGAGGATCTTCACCGCGCGCCTCTACTTCTGTGAGGACC

GCAAGGCTGAGCCCGAGGGGCTGCGGCGGCTGCACCGCGCCGGGGTGCAAATAGCCATCATGACCTTCAA
```

-continued

```
AGGTGCGAAAGGGCCTTCCGCGCAGGCGCAGTGCAGCAGCCCGCATTCGGGATTGCGATGCGGAATGAAT

GAGTTAGTGGGGAAGCTCGAGGGGAAGAAGTGGGCGGGGATTCTGGTTCACCTCTGGAGCCGAAATTAAA

GATTAGAAGCAGAGAAAAGAGTGAATGGCTCAGAGACAAGGCCCCGAGGAAATGAGAAAATGGGGCCAGG

GTTGCTTCTTTCCCCTCGATTTGGAACCTGAACTGTCTTCTACCCCCATATCCCCGCCTTTTTTTCCTTT

TTTTTTTTTTGAAGATTATTTTTACTGCTGGAATACTTTTGTAGAAAACCACGAAAGAACTTTCAAAGCC

TGGGAAGGGCTGCATGAAAATTCAGTTCGTCTCTCCAGACAGCTTCGGCGCATCCTTTTGGTAAGGGGCT

TCCTCGCTTTTTAAATTTTCTTTCTTTCTCTACAGTCTTTTTTGGAGTTTCGTATATTTCTTATATTTTC

TTATTGTTCAATCACTCTCAGTTTTCATCTGATGAAAACTTTATTTCTCCTCCACATCAGCTTTTTCTTC

TGCTGTTTCACCATTCAGAGCCCTCTGCTAAGGTTCCTTTTCCCTCCCTTTTCTTTCTTTTGTTGTTTCA

CATCTTTAAATTTCTGTCTCTCCCCAGGGTTGCGTTTCCTTCCTGGTCAGAATTCTTTTCTCCTTTTTTT

TTTTTTTTTTTTTTTTTTTAAACAAACAAACAAAAAACCCAAAAAAACTCTTTCCCAATTTACTTTCTT

CCAACATGTTACAAAGCCATCCACTCAGTTTAGAAGACTCTCCGGCCCCACCGACCCCCAACCTCGTTTT

GAAGCCATTCACTCAATTTGCTTCTCTCTTTCTCTACAGCCCCTGTATGAGGTTGATGACTTACGAGACG

CATTTCGTACTTTGGGACTTTGATAGCAACTTCCAGGAATGTCACACACGATGAAATATCTCTGCTGAAG

ACAGTGGATAAAAAACAGTCCTTCAAGTCTTCTCTGTTTTTATTCTTCAACTCTCACTTTCTTAGAGTTT

ACAGAAAAAATATTTATATACGACTCTTTAAAAAGATCTATGTCTTGAAAATAGAGAAGGAACACAGGTC

TGGCCAGGGACGTGCTGCAATTGGTGCAGTTTTGAATGCAACATTGTCCCCTACTGGGAATAACAGAACT

GCAGGACCTGGGAGCATCCTAAAGTGTCAACGTTTTTCTATGACTTTTAGGTAGGATGAGAGCAGAAGGT

AGATCCTAAAAAGCATGGTGAGAGGATCAAATGTTTTTATATCAACATCCTTTATTATTTGATTCATTTG

AGTTAACAGTGGTGTTAGTGATAGATTTTTCTATTCTTTTCCCTTGACGTTTACTTTCAAGTAACACAAA

CTCTTCCATCAGGCCATGATCTATAGGACCTCCTAATGAGAGTATCTGGGTGATTGTGACCCCAAACCAT

CTCTCCAAAGCATTAATATCCAATCATGCGCTGTATGTTTTAATCAGCAGAAGCATGTTTTTATGTTTGT

ACAAAAGAAGATTGTTATGGGTGGGGATGGAGGTATAGACCATGCATGGTCACCTTCAAGCTACTTTAAT

AAAGGATCTTAAAATGGGCAGGAGGACTGTGAACAAGACACCCTAATAATGGGTTGATGTCTGAAGTAGC

AAATCTTCTGGAAACGCAAACTCTTTTAAGGAAGTCCCTAATTTAGAAACACCCACAAACTTCACATATC

ATAATTAGCAAACAATTGGAAGGAAGTTGCTTGAATGTTGGGGAGAGGAAAATCTATTGGCTCTCGTGGG

TCTCTTCATCTCAGAAATGCCAATCAGGTCAAGGTTTGCTACATTTTGTATGTGTGTGATGCTTCTCCCA

AAGGTATATTAACTATATAAGAGAGTTGTGACAAAACAGAATGATAAAGCTGCGAACCGTGGCACACGCT

CATAGTTCTAGCTGCTTGGGAGGTTGAGGAGGGAGGATGGCTTGAACACAGGTGTTCAAGGCCAGCCTGG

GCAACATAACAAGATCCTGTCTCTCAAAAAAAAAAAAAAAAAAAAAGAAAGAGAGAGGGCCGGGCGTGGTG

GCTCACGCCTGTAATCCCAGCACTTTGGGAGGCCGAGCCGGGCGGATCACCTGTGGTCAGGAGTTTGAGA

CCAGCCTGGCCAACATGGCAAAACCCCGTCTGTACTCAAAATGCAAAAATTAGCCAGGCGTGGTAGCAGG

CACCTGTAATCCCAGCTACTTGGGAGGCTGAGGCAGGAGAATCGCTTGAACCCAGGAGGTGGAGGTTGCA

GTAAGCTGAGATCGTGCCGTTGCACTCCAGCCTGGGCGACAAGAGCAAGACTCTGTCTCAGAAAAAAAAA

AAAAAAGAGAGAGAGAGAGAAAGAGAACAATATTTGGGAGAGAAGGATGGGGAAGCATTGCAAGGAAAT

TGTGCTTTATCCAACAAATGTAAGGAGCCAATAAGGGATCCCTATTTGTCTCTTTTGGTGTCTATTTGT

CCCTAACAACTGTCTTTGACAGTGAGAAAAATATTCAGAATAACCATATCCCTGTGCCGTTATTACCTAG

CAACCCTTGCAATGAAGATGAGCAGATCCACAGGAAAACTTGAATGCACAACTGTCTTATTTTAATCTTA

TTGTACATAAGTTTGTAAAAGAGTTAAAAATTGTTACTTCATGTATTCATTTATATTTTATATTATTTTG

CGTCTAATGATTTTTTATTAACATGATTTCCTTTTCTGATATATTGAAATGGAGTCTCAAAGCTTCATAA
```

-continued

ATTTATAACTTTAGAAATGATTCTAATAACAACGTATGTAATTGTAACATTGCAGTAATGGTGCTACGAA

GCCATTTCTCTTGATTTTTAGTAAACTTTTATGACAGCAAATTTGCTTCTGGCTCACTTTCAATCAGTTA

AATAAATGATAAATAATTTTGGAAGCTGTGAAGATAAAATACCAAATAAAATAATATAAAAGTGATTTAT

ATGAAGTTAAAATAAAAAATCAGTATGATGGAATAAACTTG

Apolipoprotein B mRNA editing enzyme, catalytic polypeptide-like (APOBEC) is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. A number of modified cytidine deaminases are commercially available, including but not limited to SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177).

Other exemplary deaminases that can be fused to Cas9 according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

Human AID:
MDSLLMNRRKFLYQFKNVRWAKGRRETYLCYVVKRRDSATSFSLDFGYLRNKNGCHVELLFLRYISDW

DLDPGRCYRVTWFTSWSPCYDCARHVADFLRGNPNLSLRIFTARLYFCEDRKAEPEGLRRLHRAGVQI

AIMTFKDYFYCWNTFVENHERTFKAWEGLHENSVRLSRQLRRILLPLYEVDDLRDAFRTLGL (underline: nuclear localization sequence; double underline:

nuclear export signal)

Mouse AID:
MDSLLMKQKKFLYHFKNVRWAKGRHETYLCYVVKRRDSATSCSLDFGHLRNKSGCHVELLFLRYISDW

DLDPGRCYRVTWFTSWSPCYDCARHVAEFLRWNPNLSLRIFTARLYFCEDRKAEPEGLRRLHRAGVQI

GIMTFKDYFYCWNTFVENRERTFKAWEGLHENSVRLTRQLRRILLPLYEVDDLRDAFRMLGF (underline: nuclear localization sequence; double underline:

nuclear export signal)

Dog AID:
MDSLLMKQRKFLYHFKNVRWAKGRHETYLCYVVKRRDSATSFSLDFGHLRNKSGCHVELLFLRYISDW

DLDPGRCYRVTWFTSWSPCYDCARHVADFLRGYPNLSLRIFAARLYFCEDRKAEPEGLRRLHRAGVQI

AIMTFKDYFYCWNTFVENREKTFKAWEGLHENSVRLSRQLRRILLPLYEVDDLRDAFRTLGL (underline: nuclear localization sequence; double underline:

nuclear export signal)

Bovine AID:
MDSLLKKQRQFLYQFKNVRWAKGRHETYLCYVVKRRDSPTSFSLDFGHLRNKAGCHVELLFLRYISDW

DLDPGRCYRVTWFTSWSPCYDCARHVADFLRGYPNLSLRIFTARLYFCDKERKAEPEGLRRLHRAGVQ

IAIMTFKDYFYCWNTFVENHERTFKAWEGLHENSVRLSRQLRRILLPLYEVDDLRDAFRTLGL (underline: nuclear localization sequence, double underline:

nuclear export signal)

Rat AID
MAVGSKPKAALVGPHWERERIWCFLCSTGLGTQQTGQTSRWLRPAATQDPVSPPRSLLMKQRKFLYHF

KNVRWAKGRHETYLCYVVKRRDSATSFSLDFGYLRNKSGCHVELLFLRYISDWDLDPGRCYRVTWFTS

-continued

WSPCYDCARHVADFLRGNPNLSLRIFTARLTGWGALPAGLMSPARPSDYFYCWNTFV<u>ENHERTFKAWE</u>

<u>GLHENSVRLSRRLRRILLPLYEVDDLRDAFRTLGL</u> (underline: nuclear localization sequence; double underline: nuclear export signal)

Mouse APOBEC-3
MGPFCLGCSHRKCYSPIRNLISQETFKFHFKNLGYAKGRKDTFLCYEVTRKDCDSPVSLHHGVFKNKD

NI*HAEICELYWFHDKVLKVLSPREEFKITWYMSWSPCFEC*AEQIVRFLATHHNLSLDIFSSRLYNVQD

PETQQNLCRLVQEGAQVAAMDLYEFKKCWKKEVDNGGRRFRPWKRLLTNFRYQDSKLQEILRPCYIPV

PSSSSSTLSNICLIKGLPETRFCVEGRRMDPLSEEEFYSQFYNQRVKHLCYYHRMKPYLCYQLEQFNG

QAPLKGCLLSEKGKQ*HAEILELDKIRSMELSQVTITCYLTWSPCPN*CAWQLAAFKRDRPDLILHIYTS

RLYFHWKRPFQKGLCSLWQSGILVDVMDLPQFTDCWTNFVNPKRPFWPWKGLEIISRRTQRRLRRIKE

SWGLQDLVNDFGNLQLGPPMS (italic: nucleic acid editing domain)

Rat APOBEC-3:
MGPFCLGCSHRKCYSPIRNLISQETFKFHFKNRLRYAIDRKDTFLCYEVTRKDCDSPVSLHHGVFKNK

DNI*HAEICFLYWFHDKVLKVLSPREEFKITWYMSWSPCFEC*AEQVLRFLATHHNLSLDIFSSRLYNIR

DPENQQNLCRLVQEGAQVAAMDLYEFKKCWKKFVDNGGRRFRPWKKLLTNFRYQDSKLQEILRPCYIP

VPSSSSSTLSNICLTKGLPETRFCVERRRVHLLSEEEFYSQFYNQRVKHLCYYHGVKPYLCYQLEQFN

GQAPLKGCLLSEKGKQ*HAEILFZDKIRSMEISQVIITCYLTWSPCPN*CAWQLAAFKRDRPDLILHIYT

SRLYFHWKRPFQKGLCSLWQSGILVDVMDLPQFTDCWTNFVNPKRPFWPWKGLEIISRRTQRRLHRIK

ESWGLQDLVNDFGNLQLGPPMS (italic: nucleic acid editing domain)

Rhesus macaque APOBEC-3G:
<u>MVEPMDPRTFVSNFNNRPILSGLNTVWLCCEVKTKDPSGPPLDAKIFQGKVYSKAKYHPEM</u>RFLRWFH

KWRQLHHDQEYKVTWYVSWSPCTRCANSVATFLAKDPKVTLTIFVARLYYFWKPDYQQALRILCQKRG

GPHATMKIMNYNEFQDCWNKFVDGRGKPFKPRNNLPKHYTLLQATLGELLRHLMDPGTFTSNFNNKPW

VSGQHETYLCYKVERLHNDTWVPLNQHRGFLRNQAPNIHGFPKGRHAELCFLDLIPFWKLDGQQYRVT

CFTSWSPCFSCAQEMAKFISNNEHVSLCIFAARIYDDQGRYQEGLRALHRDGAKIAMMNYSEFEYCWD

TFVDRQGRPFQPWDGLDEHSQALSGRLRAI (italic: nucleic acid editing domain;

underline: cytoplasmic localization signal)

Chimpanzee APOBEC-3G:
<u>MKPHFRNPVERMYQDTFSDNFYNRPILSHRNTVWLCYEVKTKGPSRPPLDAKIFRGQVYSKLKY</u>*HPEM*

*RFFHWFSKWRKLHRDQEYEVTWYISWSPCTKC*IRDVATFLAEDPKVTLTIFVARLYYFWDPDYQEALR

SLCQKRDGPRATMKIMNYDEFQHCWSKFVYSQRELFEPWNNLPKYYILLHIMLGEILRHSMDPPTFTS

NFNNELWVRGRHETYLCYEVERLHNDTWVLLNQRRGFLCNQAPHKHGFLEGR*HAELCFLDVIPFWKLD*

*LHQDYRVTCFTSWSPCFSC*AQEMAKFISNNKHVSLCIFAARIYDDQGRCQEGLRTLAKAGAKISIMTY

SEFKHCWDTFVDHQGCPFQPWDGLEEHSQALSGRLRAILQNQGN (italic: nucleic acid editing domain; underline: cytoplasmic localization signal)

Green monkey APOBEC-3G:
<u>MNPQIRNMVEQMEPDIFVYYFNNRPILSGRNTVWLCYEVKTKDPSGPPLDANIFQGKLYPEAKD</u>*HPEM*

*KFLHWFRKWRQLHRDQEYEVTWYVSWSPCTRC*ANSVATFLAEDPKVTLTIFVARLYYFWKPDYQQALR

ILCQERGGPHATMKIMNYNEFQHCWNEFVDGQGKPFKPRKNLPKHYTLLHATLCELLRHVMDPGTFTS

NFNNKPWVSGQRETYLCYKVERSHNDTWVLLNQHRGFLRNQAPDRHGFPKGR*HAELCFLDLIPFWKLD*

*DQQYRVTCFTSWSPCFSC*AQKMAKFISNNKHVSLCIFAARIYDDQGRCQEGLRTLHRDGAKIAVMNYS

EFEYCWDTFVDRQGRPFQPWDGLDEHSQALSGRLRAI (italic: nucleic acid editing domain; underline: cytoplasmic localization signal)

-continued

Human APOBEC-3G:
MKPHFRNTVERMYRDTFSYNFYNRPILSRRNTVWLCYEVKTKGPSRPPLDAKIFRGQVYSELKY*HPEM*

*RFFHWFSKWRKLHRDQEYEVTWYISWSPCTKC*TRDMATFLAEDPKVTLTIFVARLYYFWDPDYQEALR

SLCQKRDGPRATMKIMNYDEFQHCWSKFVYSQRELFEPWNNLPKYYILLHIMLGEILRHSMDPPTFTF

NFNNEPWVRGRHETYLCYEVERMHNDTWVLLNQRRGFLCNQAPHKHGFLEGR*HAELCFLDVIPFWKLD*

*LDQDYRVTCFTSWSPCFSC*AQEMAKFISKNKHVSLCIFTARIYDDQGRCQEGLRTLAEAGAKISIMTY

SEFKHCWDTFVDHQGCPFQPWDGLDEHSQDLSGRLRAILQNQEN (italic: nucleic acid editing domain; underline: cytoplasmic localization signal)

Human APOBEC-3F:
MKPHFRNTVERMYRDTFSYNFYNRPILSRRNTVWLCYEVKTKGPSRPRLDAKIFRGQVYSQPEH*HAEM*

*CFLSWFCGNQLPAYKCFQITWFVSWTPCPDC*VAKLAEFLAEHPNVTLTISAARLYYYWERDYRRALCR

LSQAGARVKIMDDEEFAYCWENFVYSEGQPFMPWYKFDDNYAFLHRTLKEILRNPMEAMYPHIFYFHF

KNLRKAYGRNESWLCFTMEVVKHHSPVSWKRGVFRNQVDPETH*CHAERCFLSWFCDDILSPNTNYEVT*

*WYTSWSPCPEC*AGEVAEFLARHSNVNLTIFTARLYYFWDTDYQEGLRSLSQEGASVEIMGYKDFKYCW

ENFVYNDDEPFKPWKGLKYNLFLFLDSKLQEILE (italic: nucleic acid editing domain)

Human APOBEC-3B:
MNPQIRNPMERMYRDTFYDNFENEPILYGRSYTWLCYEVKIKRGRSNLLWDTGVFRGQVYFKPQY*HAE*

*MCFLSWFCGNQLPAYKCFQITWFVSWTPCPDC*VAKLAEFLSEHPNVTLTISAARLYYYWERDYRRALC

RLSQAGARVTIMDYEEFAYCWENFVYNEGQQFMPWYKFDENYAFLHRTLKEILRYLMDPDTFTFNFNN

DPLVLRRRQTYLCYEVERLDNGTWVLMDQHMGFLCNEAKNLLCGFY*GRHAELRFLDLVPSLQLDPAQI*

*YRVTWFISWSPCFSWGC*AGEVRAFLQENTHVRLRIFAARIYDYDPLYKEALQMLRDAGAQVSIMTYDE

FEYCWDTFVYRQGCPFQPWDGLEEHSQALSGRLRAILQNQGN (italic: nucleic acid editing domain)

Rat APOBEC-3B:
MQPQGLGPNAGMGPVCLGCSHRRPYSPIRNPLKKLYQQTFYFHFKNVRYAWGRKNNFLCYEVNGMDCA

LPVPLRQGVFRKQCHIHAELCFIYWFHDKVLRVLSPMEEFKVTWYMSWSPCSKCAEQVARFLAAHRNL

SLAIFSSRLYYYLRNPNYQQKLCRLIQEGVHVAAMDLPEFKKCWNKFVDNDGQPFRPWMRLRINFSFY

DCKLQEIFSRMNLLREDVFYLQFNNSHRVKPVQNRYYRRKSYLCYQLERANGQEPLKGYLLYKKGEQH

VEILFLEKMRSMELSQVRITCYLTWSPCPNCARQLAAFKKDHPDLILRIYTSRLYFWRKKFQKGLCTL

WRSGIHVDVMDLPQFADCWTNFVNPQRPFRPWNELEKNSWRIQRRLRRIKESWGL

Bovine APOBEC-3B:
DGWEVAFRSGTVLKAGVLGVSMTEGWAGSGHPGQGACVWTPGTRNIMNLLREVLFKQQFGNQPRVPAP

YYRRKTYLCYQLKQRNDLTLDRGCFRNKKQRHAERFIDKINSLDLNPSQSYKIICYITWSPCPNCANE

LVNFITRNNHLKLEIFASRLYFHWIKSFKMGLQDLQNAGISVAVMTHTEFEDCWEQFVDNQSRPFQPW

DKLEQYSASIRRRLQRILTAPI

Chimpanzee APOBEC-3B:
MNPQIRNPMEWMYQRTFYYNFENEPILYGRSYTWLCYEVKIRRGHSNLLWDTGVFRGQMYSQPEHHAE

MCFLSWFCGNQLSAYKCFQITWFVSWTPCPDCVAKLAKFLAEHPNVTLTISAARLYYYWERDYRRALC

RLSQAGARVKIMDDEEFAYCWENFVYNEGQPFMPWYKFDDNYAFLHRTLKEIIRHLMDPDTFTFNFNN

DPLVLRRHQTYLCYEVERLDNGTWVLMDQHMGFLCNEAKNLLCGFYGRHAELRFLDLVPSLQLDPAQI

YRVTWFISWSPCFSWGCAGQVRAFLQENTHVRLRIFAARIYDYDPLYKEALQMLRDAGAQVSIMTYDE

-continued

FEYCWDTFVYRQGCPFQPWDGLEEHSQALSGRLRAILQVRASSLCMVPHRPPPPPQSPGPCLPLCSEP

PLGSLLPTGRPAPSLPFLLTASFSFPPPASLPPLPSLSLSPGHLPVPSFHSLTSCSIQPPCSSRIRET

EGWASVSKEGRDLG

Human APOBEC-3C:
MNPQIRNPMKAMYPGTFYFQFKNLWEANDRNETWLCFTVEGIKRRSVVSWKTGVFRNQVDSETH*CHAE*

*RCFLSWFCDDILSPNTKYQVTWYTSWSPCPDC*AGEVAEFLARHSNVNLTIFTARLYYFQYPCYQEGLR

SLSQEGVAVEIMDYEDFKYCWENFVYNDNEPFKPWKGLKTNFRLLKRRLRESLQ

Gorilla APOBEC3C
MNPQIRNPMKAMYPGTFYFQFKNLWEANDRNETWLCFTVEGIKRRSVVSWKTGVFRNQVDSETH*CHAE*

*RCFLSWECDDILSPNTNYQVTWYTSWSPCPEC*AGEVAEFLARHSNVNLTIFTARLYYFQDTDYQEGLR

SLSQEGVAVKIMDYKDFKYCWENFVYNDDEPFKPWKGLKYNFRFLKRRLQEILE (italic:

nucleic acid editing domain)

Human APOBEC-3A:
MEASPASGPRHLMDPHIFTSNFNNGIGRHKTYLCYEVERLDNGTSVKMDQHRGFLHNQAKNLLCGFYG

*RHAELRFLDLVPSLOLDPAQTYRVTWFISWSPCFSWGC*AGEVRAFLQENTHVRLRIFAARIYDYDPLY

KEALQMLRDAGAQVSIMTYDEFKHCWDTFVDHQGCPFQPWDGLDEHSQALSGRLRAILQNQGN (italic: nucleic acid editing domain)

Rhesus macaque APOBEC-3A:
MDGSPASRPRHLMDPNTFTFNFNNDLSVRGRHQTYLCYEVERLDNGTWVPMDERRGFLCNKAKNVPCG

DYGC*HVELRFLCEVPSWQLDPAQTYRVTWFISWSPC*FRRGCAGQVRVFLQENKHVRLRIFAARIYDYD

PLYQEALRTLRDAGAQVSIMTYEEFKHCWDTFVDRQGRPEQPWDGLDEHSQALSGRLRAILQNQGN (italic: nucleic acid editing domain)

Bovine APOBEC-3A:
MDEYTFTENFNNQGWPSKTYLCYEMERLDGDATIPLDEYKGFVRNKGLDQPEKPC*HAELYFLGKIHSW*

*NLDRNQHYRLTCFISWSPC*YDCAQKLTTFLKENHHISLHILASRIYTHNRFGCHQSGLCELQAAGARI

TIMTFEDFKHCWETFVDHKGKPFQPWEGLNVKSQALCTELQAILKTQQN (italic: nucleic acid editing domain)

Human APOBEC-3H:
MALLTAETFRLQFNNKRRLRRPYYPRKALLCYQLTPQNGSTPTRGYFENKKKC*HAEICFINEIKSMGL*

*DETQCYQVTCYLTWSPCSSC*AWELVDFIKAHDHLNLGIFASRLYYHWCKPQQKGLRLLCGSQVPVEVM

GFPKFADCWENFVDHEKPLSFNPYKMLEELDKNSRAIKRRLERIKIPGVRAQGRYMDILCDAEV (italic: nucleic acid editing domain)

Rhesus macaque APOBEC-3H:
MALLTAKTFSLQFNNKRRVNKPYYPRKALLCYQLTPQNGSTPTRGHLKNKKKDHAEIRFINKIKSMGL

DETQCYQVTCYLTWSPCPSCAGELVDFIKAHRHLNLRIFASRLYYHWRPNYQEGLLLLCGSQVPVEVM

GLPEFTDCWENFVDHKEPPSFNPSEKLEELDKNSQAIKRRLERIKSRSVDVLENGLRSLQLGPVTP*SS*

*SIRNSR*

Human APOBEC-3D:
MNPQIRNPMERMYRDTFYDNFENEPILYGRSYTWLCYEVKIKRGRSNLLWDTGVFRGPVLPKRQSNHR

QEVYFRFEN*HAEMCFLSWFCGNRLPANRRFQITWFVSWNPC*LPCVVKVTKFLAEHPNVTLTISAARLY

YYRDRDWRWVLLRLHKAGARVKIMDYEDFAYCWENFVCNEGQPFMPWYKFDDNYASLHRTLKEILRNP

MEAMYPHIFYFHFKNLLKACGRNESWLCFTMEVTKHHSAVFRKRGVFRNQVDPETHC*HAERCFLSWFC*

-continued

*DDILSPNTNYEVTWYTSWSPCPEC*AGEVAEFLARHSNVNLTIFTARLCYFWDTDYQEGLCSLSQEGAS

VKIMGYKDFVSCWKNFVYSDDEPFKPWKGLQTNFRLLKRRLREILQ (italic: nucleic acid editing domain)

Human APOBEC-1:
MTSEKGPSTGDPTLRRRIEPWEFDVFYDPRELRKEACLLYEIKWGMSRKIWRSSGKNTTNHVEVNFIK

KFTSERDFHPSMSCSITWFLSWSPCWECSQAIREFLSRHPGVTLVIYVARLFWHMDQQNRQGLRDLVN

SGVTIQIMRASEYYHCWRNFVNYPPGDEAHWPQYPPLWMMLYALELHCIILSLPPCLKISRRWQNHLT

FFRLHLQNCHYQTIPPHILLATGLIHPSVAWR

Mouse APOBEC-1:
MSSETGPVAVDPTLRRRIEPHEFEVFFDPRELRKETCLLYEINWGGRHSVWRHTSQNTSNHVEVNFLE

KFTTERYFRPNTRCSITWFLSWSPCGECSRAITEFLSRHPYVTLFIYIARLYHHTDQRNRQGLRDLIS

SGVTIQIMTEQEYCYCWRNFVNYPPSNEAYWPRYPHLWVKLYVLELYCIILGLPPCLKILRRKQPQLT

FETITLQTCHYQRIPPHLLWATGLK

Rat APOBEC-1:
MSSETGPVAVDPTLRRRIEPHEFEVFFDPRELRKETCLLYEINWGGRHSIWRHTSQNTNKHVEVNFIE

KFTTERYFCPNTRCSITWFLSWSPCGECSRAITEFLSRYPHVTLFIYIARLYHHADPRNRQGLRDLIS

SGVTIQIMTEQESGYCWRNFVNYSPSNEAHWPRYPHLWVRLYVLELYCIILGLPPCLNILRRKQPQLT

PETIALQSCHYQRLPPHILWATGLK

Human APOBEC-2:
MAQKEEAAVATEAASQNGEDLENLDDPEKLKELIELPPFEIVTGERLPANEFKFQFRNVEYSSGRNKT

FLCYVVEAQGKGGQVQASRGYLEDEHAAAHAEEAFFNTILPAFDPALRYNVTWYVSSSPCAACADRII

KTLSKTKNLRLLILVGRLFMWEEPEIQAALKKLKEAGCKLRIMKPQDFEYVWQNFVEQEEGESKAFQP

WEDIQENFLYYEEKLADILK

Mouse APOBEC-2:
MAQKEEAAEAAAPASQNGDDLENLEDPEKLKELIDLPPFEIVTGVRLPVNFFKFQFRNVEYSSGRNKT

FLCYVVEVQSKGGQAQATQGYLEDEHAGAHAEEAFFNTILPAFDPALKYNVTWYVSSSPCAACADRIL

KTLSKTKNLRLLILVSRLFMWEEPEVQAALKKLKEAGCKLRIMKPQDFEYIWQNFVEQEEGESKAFEP

WEDIQFNFLYYEEKLADILK

Rat APOBEC-2:
MAQKEEAAEAAAPASQNGDDLENLEDPEKLKELIDLPPFEIVTGVRLPVNFFKFQFRNVEYSSGRNKT

FLCYVVEAQSKGGQVQATQGYLEDEHAGAHAEEAFFNTILPAFDPALKYNVTWYVSSSPCAACADRIL

KTLSKIKNLRLLILVSRLFMWEEPEVQAALKKLKEAGCKLRIMKPQDFEYLWQNFVEQEEGESKAFEP

WEDIQENFLYYEEKLADILK

Bovine APOBEC-2:
MAQKEEAAAAAEPASQNGEEVENLEDPEKLKELIELPPFEIVTGERLPAHYFKFQFRNVEYSSGRNKT

FLCYVVEAQSKGGQVQASRGYLEDEHATNHAEEAFFNSIMPTFDPALRYMVTWYVSSSPCAACADRIV

KTLNKTKNLRLLILVGRLFMWEEPEIQAALRKLKEAGCRLRIMKPQDFEYIWQNFVEQEEGESKAFEP

WEDIQENFLYYEEKLADILK

*Petromyzon marinus* CDA1 (pmCDA1)
MTDAEYVRIHEKLDIYTFKKQFFNNKKSVSHRCYVLFELKRRGERRACFWGYAVNKPQSGTERGIHAE

IFSIRKVEEYLRDNPGQFTINWYSSWSPCADCAEKILEWYNQELRGNGHTLKIWACKLYYEKNARNQI

GLWNLRDNGVGLNVMVSEHYQCCRKIFIQSSHNQLNENRWLEKTLKRAEKRRSELSFMIQVKILHTTK

SPAV

59

60

-continued

Human APOBEC3G D316R D317R
MKPHFRNTVERMYRDTFSYNFYNRPILSRRNTVWLCYEVKTKGPSRPPLDAKIFRGQVYSELKYHPEM

RFFHWFSKWRKLHRDQEYEVTWYISWSPCTKCTRDMATFLAEDPKVTLTIFVARLYYFWDPDYQEALR

SLCQKRDGPRATMKFNYDEFQHCWSKFVYSQRELFEPWNNLPKYYILLHFMLGEILRHSMDPPTFTFN

FNNEPWVRGRHETYLCYEVERMHNDTWVLLNQRRGFLCNQAPHKHGFLEGRHAELCFLDVIPFWKLDL

DQDYRVTCFTSWSPCFSCAQEMAKFISKKHVSLCIFTARIYRRQGRCQEGLRTLAEAGAKISFTYSEF

KHCWDTFVDHQGCPFQPWDGLDEHSQDLSGRLRAILQNQEN

Human APOBEC3G chain A
MDPPTFTFNFNNEPWWGRHETYLCYEVERMHNDTWVLLNQRRGFLCNQAPHKHGFLEGRHAELCFLDV

IPFWKLDLDQDYRVTCFTSWSPCFSCAQEMAKFISKNKHVSLCIFIARIYDDQGRCQEGLRILAEAGA

KISFTYSEFKHCWDTFVDHQGCPFQPWDGLDEHSQDLSGRLRAILQ

Human APOBEC3G chain A D120R D121R
MDPPTFTFNFNNEPWVRGRHETYLCYEVERMHNDTWVLLNQRRGFLCNQAPHKHGFLEGRHAELCFLD

VIPFWKLDLDQDYRVTCFTSWSPCFSCAQEMAKFISKNKHVSLCIFTARIYRRQGRCQEGLRTLAEAG

AKISFMTYSEFKHCWDTFVDHQGCPFQPWDGLDEHSQDLSGRLRAILQ

The term "deaminase" or "deaminase domain" refers to a protein or fragment thereof that catalyzes a deamination reaction.

"Detect" refers to identifying the presence, absence or amount of the analyte to be detected. In one embodiment, a sequence alteration in a polynucleotide or polypeptide is detected. In another embodiment, the presence of indels is detected.

By "detectable label" is meant a composition that when linked to a molecule of interest renders the latter detectable, via spectroscopic, photochemical, biochemical, immuno-chemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "fragment" is meant a portion of a polypeptide or nucleic acid molecule. This portion contains, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

The term "inhibitor of base repair" or "IBR" refers to a protein that is capable in inhibiting the activity of a nucleic acid repair enzyme, for example a base excision repair enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 Endo1, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker," as used herein, refers to a bond (e.g., covalent bond), chemical group, or a molecule linking two molecules or moieties, e.g., two domains of a fusion protein. In some embodiments, a linker joins a gRNA binding domain of an RNA-programmable nuclease, including a Cas9 nuclease domain, and the catalytic domain of a nucleic-acid editing protein (e.g., cytidine or adenosine deaminase). In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated. In some embodiments, a linker comprises the amino acid sequence SGSETPGTSESATPES (SEQ ID NO: 8), which may also be referred to as the XTEN linker. In some embodiments, a linker comprises the amino acid sequence SGGS (SEQ ID NO: 80). In some embodiments, a linker comprises (SGGS)$_n$ (SEQ ID NO: 2), (GGGS)$_n$ (SEQ ID NO: 3), (GGGGS)$_n$ (SEQ ID NO: 4), (G)$_n$ (SEQ ID NO: 5), (EAAAK)$_n$ (SEQ ID NO: 6), (GGS)$_n$ (SEQ ID NO: 7), SGSETPGTSESATPES (SEQ ID NO: 8), or (XP)$_n$ motif (SEQ ID NO: 9), or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

In some embodiments, the domains of the nucleobase editor are fused via a linker that comprises the amino acid sequence of SGGSSGSETPGTSESATPESSGGS (SEQ ID NO: 81), SGGSSGGSSGSETPGTSESATPESSGGSSGGS (SEQ ID NO: 82), or GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS (SEQ ID NO: 83). In some embodiments, domains of the nucleobase editor are fused via a linker comprising the amino acid sequence SGSETPGTSESATPES (SEQ ID NO: 8), which may also be referred to as the XTEN linker. In some embodiments, the linker is 24 amino acids in length. In some embodiments, the linker comprises the amino acid sequence SGGSSGGSSGSETPGTSESATPES (SEQ ID NO: 84). In some embodiments, the linker is 40 amino acids in length. In some embodiments, the linker comprises the amino acid sequence SGGSSGGSSGSETPGTSESATPESSGGSSGGSSGGSSGGS (SEQ ID NO: 85). In some embodiments, the linker is 64 amino acids in length. In some embodiments, the linker comprises the amino acid sequence SGGSSGGSSGSETPGTSESATPESSGGSSGGSSGGSSGGSSGGSSGSETPGTSESATPESSGGS SGGS (SEQ ID NO: 86). In some embodiments, the linker is 92 amino acids in length. In some embodiments, the linker comprises the amino acid sequence PGSPAGSPTSTEEGTSESATPESGPGTSTEPSEGSAPGSPAGSPT-

STEEGTSTEPSEGSAP GTSTEPSEGSAPGTSESAT-PESGPGSEPATS (SEQ ID NO: 87).

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, and 2-thiocytidine); chemically modified bases; biologically modified bases (e.g., methylated bases); intercalated bases; modified sugars (2'-e.g., fluororibose, ribose, 2'-deoxyribose, arabinose, and hexose); and/or modified phosphate groups (e.g., phosphorothioates and 5'-N-phosphoramidite linkages).

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence KRTADGSEFESPKKKRKV (SEQ ID NO: 88), KRPAATKKAGQAKKKK (SEQ ID NO: 89), KKTELQTTNAENKTKKL (SEQ ID NO: 90), KRGINDRNFWRGENGRKTR (SEQ ID NO: 91), RKSGKIAAIVVKRPRK (SEQ ID NO: 92), PKKKRKV (SEQ ID NO: 93), or MDSLLMNRRKFLYQFKNVRWAKGRRETYLC (SEQ ID NO: 94).

The disclosure provides nucleic acid programable nucleic-acid (e.g., DNA or RNA) binding proteins. The nucleic acid programable nucleic-acid binding protein can be, for example, "nucleic acid programmable DNA binding protein" or "napDNAbp". The term "nucleic acid programmable DNA binding protein" or "napDNAbp" refers to a protein that associates with a nucleic acid (e.g., DNA or RNA), such as a guide nucleic acid, that guides the napDNAbp to a specific nucleic acid sequence. For example, a Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, Cas12b/C2c1, and Cas12c/C2c3. Other nucleic acid programmable DNA binding proteins are also within the scope of this disclosure, although they may not be specifically listed in this disclosure.

As used herein, "obtaining" as in "obtaining an agent" includes synthesizing, purchasing, or otherwise acquiring the agent.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et ah, Science 337:816-821(2012), the entire contents of which is incorporated herein by reference. Other examples of gRNAs (e.g., those including domain 2) can be found in U.S. Provisional Patent Application, Ser. No.

61/874,682, filed Sep. 6, 2013, entitled "Switchable Cas9 Nucleases And Uses Thereof," and U.S. Provisional Patent Application, Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRIS PR-associated system) Cas9 endonuclease, for example, Cas9 (Csnl) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607(2011).

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, at least about 20 amino acids, more at least about 25 amino acids, and even more preferably about 35 amino acids, about 50 amino acids, or about 100 amino acids. For nucleic acids, the length of the reference nucleic acid sequence will generally be at least about 50 nucleotides, at least about 60 nucleotides, at least about 75 nucleotides, and about 100 nucleotides or about 300 nucleotides or any integer thereabout or therebetween.

By "specifically binds" is meant a nucleic acid molecule, polypeptide, or complex thereof (e.g., a nucleic acid programmable DNA binding domain and guide nucleic acid), compound, or molecule that recognizes and binds a polypeptide and/or nucleic acid molecule of the invention, but which does not substantially recognize and bind other molecules in a sample, for example, a biological sample.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a one: embodiment, hybridization will occur at 30° C. in 750 mM NaCl, 75 mM trisodium citrate, and 1% SDS. In another embodiment, hybridization will occur at 37° C. in 500 mM NaCl, 50 mM trisodium citrate, 1% SDS, 35% formamide, and 100 mu·g/ml denatured salmon sperm DNA (ssDNA). In another embodiment, hybridization will occur at 42° C. in 250 mM NaCl, 25 mM trisodium citrate, 1% SDS, 50% formamide, and 200 g/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In an embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196:

180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). In one embodiment, such a sequence is at least 60%, 80% or 85%, 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

By "subject" is meant a mammal, including, but not limited to, a human or non-human mammal, such as a bovine, equine, canine, ovine, or feline. Subjects include livestock, domesticated animals raised to produce labor and to provide commodities, such as food, including without limitation, cattle, goats, chickens, horses, pigs, rabbits, and sheep.

The term "target site" refers to a sequence within a nucleic acid molecule that is modified by a nucleobase editor. In one embodiment, the target site is deaminated by a deaminase or a fusion protein comprising a deaminase (e.g., cytidine or adenine deaminase).

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et ah, Multiplex genome engineering using CRISPR/Cas systems. Science 339, 819-823 (2013); Mali, P. et ah, RNA-guided human genome engineering via Cas9. Science 339, 823-826 (2013); Hwang, W. Y. et ah, Efficient genome editing in zebrafish using a CRISPR-Cas system. Nature biotechnology 31, 227-229 (2013); Jinek, M. et ah, RNA-programmed genome editing in human cells. eLife 2, e00471 (2013); Dicarlo, J. E. et ah, Genome engineering in *Saccharomyces cerevisiae* using CRISPR-Cas systems. Nucleic acids research (2013); Jiang, W. et ah RNA-guided editing of bacterial genomes using CRISPR-Cas systems. Nature biotechnology 31, 233-239 (2013); the entire contents of each of which are incorporated herein by reference).

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Unless specifically stated or obvious from context, as used herein, the term "or" is understood to be inclusive. Unless specifically stated or obvious from context, as used herein, the terms "a", "an", and "the" are understood to be singular or plural.

Unless specifically stated or obvious from context, as used herein, the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

BRIEF DESCRIPTION OF THE DRAWINGS

FIG. 11 depicts potential substrates for spurious off-target base editing.

FIG. 13 is a graph depicting the activities of rAPOBEC1 in the in cis-in trans assay.

FIG. 18 is a graph depicting dose-response for in-cis and in-trans activities of cytidine nucleobase editor BE4.

FIG. 20A is a schematic of ABE7.10, with TadA fused to Cas9 by an XTEN linker. FIG. 20B-Q show base editing activity of exemplary internal fusion base editors in percentage A to G deamination on the targeting strand within the range of the R-loop with target sequences GAACACAAAGCATAGACTGC (SEQ ID NO: 95) (HEK2) and GGACAGCTTTTCCTAGACAG (SEQ ID NO: 96) (T39). FIG. 20B, editing activity of ABE7.10. FIG. 20O, editing activity of ISLAY035. FIG. 20Q, editing activity of ISLAY009.

FIG. 21A shows a schematic of exemplary base editor ABE7.10 and exemplary base editors (IBE002, IBE004, IBE005, IBE006, IBE008, IBE009, and IBE020). FIG. 21B shows a spatial cartoon representation of the above base editors, showing the location of deaminase insertion.

FIG. 22A shows editing efficiency is normalized to ABE7.10 editing at the best position. FIG. 22B shows max editing efficiency of IBEs summarized and compared to ABE7.10. FIG. 22C shows a Gaussian smoothened representation of the peak editing position for each base editor. FIG. 22D shows a heatmap of normalized editing from the 29 tested targets.

DETAILED DESCRIPTION OF THE INVENTION

Figure 1:
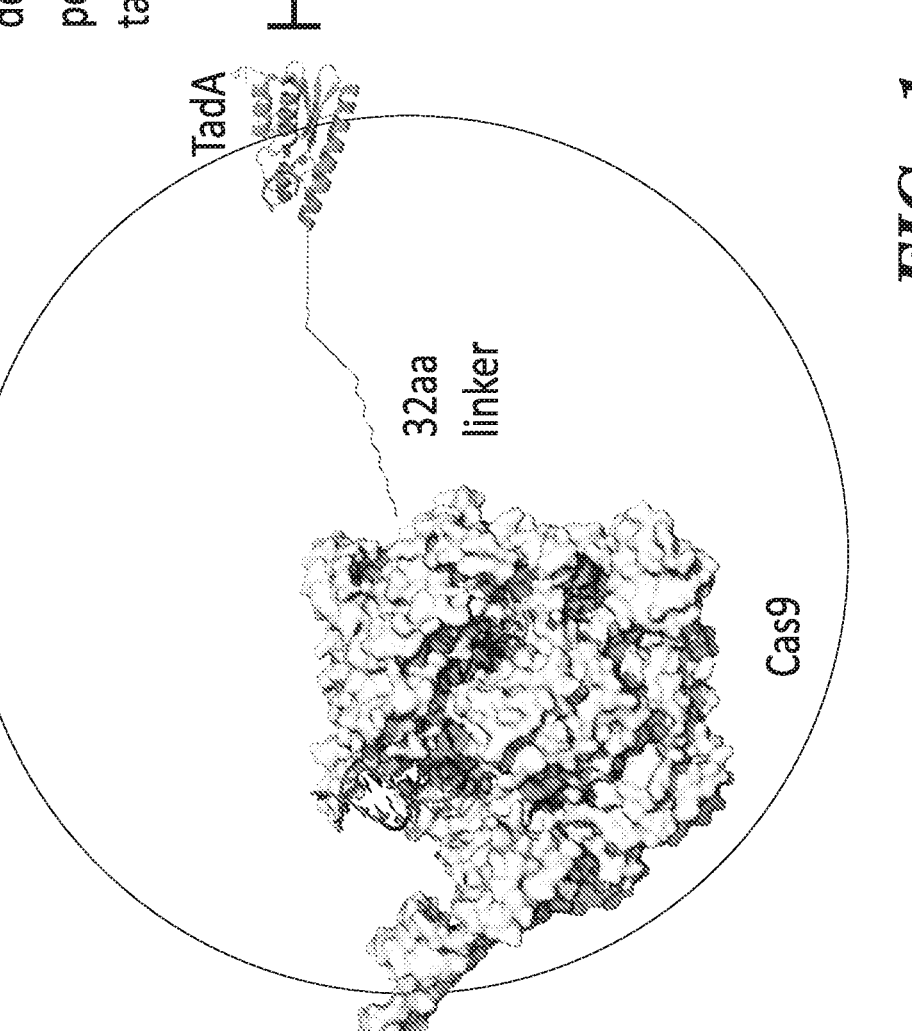
FIG. 1 depicts a model of an adenosine nucleobase editor and provides in part a structural basis for bystander mutagenesis.

As described below, the present invention features base editors having reduced non-target deamination, methods of using the base editors, and assays for characterizing base editors as having decreased non-target deamination, e.g. compared to programmed, on-target deamination.

Adenosine Deaminases

In some embodiments, the nucleobase editors of the invention comprise an adenosine deaminase domain. In some embodiments, the adenosine deaminases provided herein are capable of deaminating adenine. In some embodiments, the adenosine deaminases provided herein are capable of deaminating adenine in a deoxyadenosine residue of DNA. The adenosine deaminase may be derived from any suitable organism (e.g., *E. coli*). In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

In one embodiment, a fusion protein of the invention comprises a wild-type TadA is linked to TadA7.10, which is linked to Cas9 nickase. In particular embodiments, the fusion proteins comprise a single TadA7.10 domain (e.g., provided as a monomer). In other embodiments, the ABE7.10 editor comprises TadA7.10 and TadA(wt), which are capable of forming heterodimers. The relevant sequences follow:

```
TadA(wt):
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD

TadA7.10:
SEVEFSHEYWMRHALTLAKRARDEREVPVGAVLVLNNRVIGEGWNRAIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

PRQVFNAQKKAQSSTD
```

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identify plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments, the adenosine deaminase comprises a D108X mutation in the TadA reference sequence, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in TadA reference sequence, or a corresponding mutation in another adenosine deaminase. It should be appreciated, however, that additional deaminases may similarly be aligned to identify homologous amino acid residues that can be mutated as provided herein.

In some embodiments, the adenosine deaminase comprises an A106X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A106V mutation in TadA reference sequence, or a corresponding mutation in another adenosine deaminase.

In some embodiments, the adenosine deaminase comprises a E155X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in TadA reference sequence, or a corresponding mutation in another adenosine deaminase.

In some embodiments, the adenosine deaminase comprises a D147X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in TadA reference sequence, or a corresponding mutation in another adenosine deaminase.

It should be appreciated that any of the mutations provided herein (e.g., based on the ecTadA amino acid sequence of TadA reference sequence) may be introduced into other adenosine deaminases, such as *S. aureus* TadA (saTadA), or other adenosine deaminases (e.g., bacterial adenosine deaminases). It would be apparent to the skilled artisan how to are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, a E155V, and/or a D147Y mutation in TadA reference sequence, or a corresponding mutation in another adenosine deaminase. In some embodiments, an adenosine deaminase comprises the following group of mutations (groups of mutations are separated by a ";") in TadA reference sequence, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D 147Y; and D108N, A106V, E55V, and D147Y. It should be appreciated, however, that any combination of corresponding mutations provided herein may be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K1 1OX, M118X, N127X, A138X, F149X, M151X, R153X, Q154X, I156X, and/or K157X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95I, V102A, F104L, A 106V, R107C, or R107H, or R107P, D108G, or D108N, or D108V, or D108A, or D108Y, K1 101, M1 18K, N127S, A138V, F149Y, M151V, R153C, Q154L, I156D, and/or K157R mutation in TadA reference sequence, or one or more corresponding mutations in another adenosine deaminase.

In some embodiments, the adenosine deaminase comprises one or more of H8X, D108X, and/or N127X mutation in TadA reference sequence, or one or more corresponding mutations in another adenosine deaminase, where X indicates the presence of any amino acid.

In some embodiments, the adenosine deaminase comprises one or more of a H8Y, D108N, and/or N127S mutation in TadA reference sequence, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in TadA reference sequence, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in TadA reference sequence, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in TadA reference sequence, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H in TadA reference sequence, or a corresponding mutation or mutations in another adenosine deaminase. In some embodiments, the adenosine deaminase comprises one, two, three, four, or five, mutations selected from the group consisting of H8Y, D108N, N127S, E155V, and T166P in TadA reference sequence, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q in TadA reference sequence, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V in TadA reference sequence, or a corresponding mutation or mutations in another adenosine deaminase. In some embodiments, the adenosine deaminase comprises one, two, three, four, or five, mutations selected from the group consisting of H8Y, D108N, A109T, N127S, and E155G in TadA reference sequence, or a corresponding mutation or mutations in another adenosine deaminase.

In some embodiments, the adenosine deaminase comprises one or more of the or one or more corresponding mutations in another adenosine deaminase. In some embodiments, the adenosine deaminase comprises a D108N, D108G, or D108V mutation in TadA reference sequence, or corresponding mutations in another adenosine deaminase. In some embodiments, the adenosine deaminase comprises a A106V and D108N mutation in TadA reference sequence, or corresponding mutations in another adenosine deaminase. In some embodiments, the adenosine deaminase comprises R107C and D108N mutations in TadA reference sequence, or corresponding mutations in another adenosine deaminase. In some embodiments, the adenosine deaminase comprises a H8Y, D108N, N127S, D147Y, and Q154H mutation in TadA reference sequence, or corresponding mutations in another adenosine deaminase. In some embodiments, the adenosine deaminase comprises a H8Y, R24W, D108N, N127S, D147Y, and E155V mutation in TadA reference sequence, or corresponding mutations in another adenosine deaminase. In some embodiments, the adenosine deaminase comprises a D108N, D147Y, and E155V mutation in TadA reference sequence, or corresponding mutations in another adenosine deaminase. In some embodiments, the adenosine deaminase comprises a H8Y, D108N, and S 127S mutation in TadA reference sequence, or corresponding mutations in another adenosine deaminase. In some embodiments, the adenosine deaminase comprises a A106V, D108N, D147Y and E155V mutation in TadA reference sequence, or corresponding mutations in another adenosine deaminase.

In some embodiments, the adenosine deaminase comprises one or more of a, S2X, H8X, I49X, L84X, H123X, N127X, I156X and/or K160X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation in TadA reference sequence, or one or more corresponding mutations in another adenosine deaminase.

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in TadA reference sequence, or a corresponding mutation in another adenosine deaminase.

In some embodiments, the adenosine deaminase comprises an H123X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H123Y mutation in TadA reference sequence, or a corresponding mutation in another adenosine deaminase.

In some embodiments, the adenosine deaminase comprises an I157X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an I157F mutation in TadA reference sequence, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in TadA reference sequence, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in TadA reference sequence.

In some embodiments, the adenosine deaminase comprises one, two, three, four, or five, mutations selected from the group consisting of H8Y, A106T, D108N, N127S, and K160S in TadA reference sequence, or a corresponding mutation or mutations in another adenosine deaminase.

In some embodiments, the adenosine deaminase comprises one or more of a E25X, R26X, R107X, A142X, and/or A143X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation in TadA reference sequence, or one or more corresponding mutations in another adenosine deaminase. In some embodiments, the adenosine deaminase comprises one or more of the mutations described herein corresponding to TadA reference sequence, or one or more corresponding mutations in another adenosine deaminase.

In some embodiments, the adenosine deaminase comprises an E25X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in TadA reference sequence, or a corresponding mutation in another adenosine deaminase.

In some embodiments, the adenosine deaminase comprises an R26X mutation in TadA reference sequence, or a corresponding mutation in another adenosine deaminase, where X indicates any amino acid other than the corresponding amino acid in the wild-type adenosine deaminase. In some embodiments, the adenosine deaminase comprises R26G, R26N, R26Q, R26C, R26L, or R26K mutation in TadA reference sequence, or a corresponding mutation in another adenosine deaminase.

In some embodiments, the adenosine deaminase comprises an R107X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation in TadA reference sequence, or a corresponding mutation in another adenosine deaminase.

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in TadA reference sequence, or a corresponding mutation in another adenosine deaminase.

In some embodiments, the adenosine deaminase comprises an A143X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in TadA reference sequence, or a corresponding mutation in another adenosine deaminase.

In some embodiments, the adenosine deaminase comprises one or more of a H36X, N37X, P48X, I49X, R51X, M70X, N72X, D77X, E134X, S 146X, Q154X, K157X, and/or K161X mutation in TADA REFERENCE SEQUENCE, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S 146R, S 146C, Q154H, K157N, and/or K161T mutation in TadA reference sequence, or one or more corresponding mutations in another adenosine deaminase.

In some embodiments, the adenosine deaminase comprises an H36X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H36L mutation in TadA reference sequence, or a corresponding mutation in another adenosine deaminase.

In some embodiments, the adenosine deaminase comprises an N37X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an N37T, or N37S mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an P48T, or P48L mutation in TadA reference sequence, or a corresponding mutation in another adenosine deaminase.

In some embodiments, the adenosine deaminase comprises an R51X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R51H, or R51L mutation in TadA reference sequence, or a corresponding mutation in another adenosine deaminase.

In some embodiments, the adenosine deaminase comprises an S146X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an S 146R, or S 146C mutation in TadA reference sequence, or a corresponding mutation in another adenosine deaminase.

In some embodiments, the adenosine deaminase comprises an K157X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a K157N mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in TadA reference sequence, or a corresponding mutation in another adenosine deaminase.

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a A142N mutation in TadA reference sequence, or a corresponding mutation in another adenosine deaminase.

In some embodiments, the adenosine deaminase comprises an W23X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a W23R, or W23L mutation in TadA reference sequence, or a corresponding mutation in another adenosine deaminase.

In some embodiments, the adenosine deaminase comprises an R152X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a R152P, or R52H mutation in TadA reference sequence, or a corresponding mutation in another adenosine deaminase.

In one embodiment, the adenosine deaminase may comprise the mutations H36L, R51L, L84F, A106V, D108N, H123Y, S 146C, D147Y, E155V, I156F, and K157N. In some embodiments, the adenosine deaminase comprises the following combination of mutations relative to TadA reference sequence, where each mutation of a combination is separated by a "_" and each combination of mutations is between parentheses: (A106V_D108N), (R107C_D108N), (H8Y_D108N_S 127S_D 147Y_Q154H), (H8Y_R24W_D108N_N127S_D147Y_E155V), (D108N_D147Y_E155V), (H8Y_D108N_S 127S), (H8Y_D108N_N127S_D147Y_Q154H), (A106V D108N D147Y E155V) (D108Q D147Y E155V) (D108M_D147Y_E155V), (D108L_D147Y_E155V), (D108K_D147Y_E155V), (D1081_D147Y_E155V), (D108F_D147Y_E155V), (A106V_D108N_D147Y), (A106V_D108M_D147Y_E155V), (E59A_A106V_D108N_D147Y_E155V), (E59A cat dead_A106V_D108N_D147Y_E155V), (L84F_A106V_D108N_H123Y_D147Y_E155V_I156Y), (L84F_A106V_D108N_H123Y_D147Y_E155V_I156F), (D103A_D014N), (G22P_D 103 A_D 104N), (G22P_D 103 A_D 104N_S 138 A), (D 103 A_D 104N_S 138A), (R26G_L84F_A106V_R107H_D108N_H123Y_A142N_ A143D_D147Y_E155V_I156F), (E25G_R26G_L84F_A106V_R107H_D108N_H123Y_ A142N_A143D_D147Y_E155V_I15 6F), (E25D_R26G_L84F_A106V_R107K_D108N_H123Y_ A142N_A143G_D147Y_E155V_I15 6F), (R26Q_L84F_A106V_D108N_H123Y_A142N_ D147Y_E155V_I156F), (E25M_R26G_L84F_A106V_R107P_D108N_H123Y_ A142N_A143D_D147Y_E155V_I15 6F), (R26C_L84F_A106V_R107H_D108N_H123Y_ A142N_D147Y_E155V_I156F), (L84F_A106V_D108N_H123Y_A142N_A143L_ D147Y_E155V_I156F), (R26G_L84F_A106V_D108N_H123Y_A142N_ D147Y_E155V_I156F), (E25A_R26G_L84F_A106V_R107N_D108N_H123Y_ A142N_A143E_D147Y_E155V_I15 6F), (R26G_L84F_A106V_R107H_D108N_H123Y_A142N_ A143D_D147Y_E155V_I156F), (A106V_D108N_A142N_D147Y_E155V), (R26G_A106V_D108N_A142N_D147Y_E155V), (E25D_R26G_A106V_R107K_D108N_A142N_A143G_ D147Y_E155V), (R26G_A106V_D108N_R107H_A142N_A143D_ D147Y_E155V), (E25D_R26G_A106V_D108N_A142N_D147Y_E155V), (A106V_R107K_D108N_A142N_D147Y_E155V), (A106V_D108N_A142N_A143G_D147Y_E155V), (A106V_D108N_A142N_A143L_D147Y_E155V), (H36L_R51L_L84F_A106V_D108N_H123Y_S 146C_D147Y_E155V_I156F_K157N), (N37T_P48T_M70L_L84F_A106V_D108N_H123Y_ D147Y_149E_E155V_I156F), (N37S_L84F_A106V_D108N_H123Y_D147Y_ E155V_I156F_K161T), (H36L_L84F_A106V_D108N_H123Y_D147Y_ Q154H_E155V_I156F), (N72S_L84F_A106V_D108N_H123Y_S 146R_D147Y_E155V_I156F), (H36L_P48L_L84F_A106V_D108N_H123Y_ E134G_D147Y_E155V_I156F), 57N), (H36L_L84F_A106V_D108N_H123Y_S 146C_D147Y_E155V_I156F), (L84F_A106V_D108N_H123Y_S 146R_D147Y_E155V_I156F_K161T), (N37S_R51H_D77G_L84F_A106V_D108N_H123Y_ D147Y_E155V_I156F), (R51L_L84F_A106V_D108N_H123Y_D147Y_ E155V_I156F_K157N), (D24G_Q71R_L84F_H96L_ A106V_D108N_H123Y_D147Y_E155V_I156F_K160E), (H36L_G67V_L84F_A106V_D108N_H123Y_S 146T_D147Y_E155V_I156F), (Q71L_L84F_A106V_D108N_H123Y_L137M_ A143E_D147Y_E155V_I156F), (E25G_L84F_A106V_D108N_H123Y_D147Y_ E155V_I156F_Q159L), (L84F_A91T_F104I_A106V_D108N_H123Y_D147Y_ E155V_I156F), (N72D_L84F_A106V_D108N_H123Y_G125A_ D147Y_E155V_I156F), (P48S_L84F_S97C_A106V_D108N_H123Y_ D147Y_E155V_I156F), (W23G_L84F_A106V_D108N_H123Y_D147Y_E155V_ I156F), (D24G_P48L_Q71R_L84F_A106V_D108N_H123Y_ D147Y_E155V_I156F_Q159L), (L84F_A106V_D108N_H123Y_A142N_D147Y_ E155V_I156F), (H36L_R51L_L84F_A106V_D108N_H123Y_A142N_S 146C_D147Y_E155V_I156F_K157N), (N37S_L84F_A106V_D108N_H123Y_A142N_ D147Y_E155V_I156F_K161T), (L84F_A106V_D108N_D147Y_E155V_I156F), (R51L_L84F_A106V_D108N_H123Y_S 146C_D147Y_E155V_I156F_K157N_K161T), (L84F_A106V_D108N_H123Y_S 146C_D147Y_E155V_I156F_K161T), (L84F_A106V_D108N_H123Y_S 146C_D147Y_E155V_I156F_K157N_K160E_K161T), (L84F_A106V_D108N_H123Y_S 146C_D147Y_E155V_I156F_K157N_K160E), (R74Q L84F_A106V_D108N_H123Y_D147Y_E155V_I156F), (R74A_L84F_A106V_D108N_H123Y_D147Y_ E155V_I156F), (L84F_A106V_D108N_H123Y_D147Y_E155V_I156F), (R74Q_L84F_A106V_D108N_H123Y_D147Y_ E155V_I156F), (L84F_R98Q_A106V_D108N_H123Y_D147Y_ E155V_I156F), (L84F_A106V_D108N_H123Y_R129Q_D147Y_ E155V_I156F), (P48S_L84F_A106V_D108N_H123Y_A142N_ D147Y_E155V_I156F), (P48S_A142N), (P48T_I49V_L84F_A106V_D108N_H123Y_A142N_ D147Y_E155V_I156F_L157N), (P48T_I49V_A142N), (H36L_P48S_R51L_L84F_A106V_D108N_H123Y_S 146C_D147Y_E155V_I156F_K157N), (H36L_P48S_R51L_L84F_A106V_D108N_H123Y_S 146C_A142N_D147Y_E155V_I156F (H36L_P48T_I49V_R51L_L84F_A106V_D108N_ H123Y_S 146C_D147Y_E155V_I156F_K157N), (H36L_P48T_149V_R51L_L84F_A106V_D108N_ H123Y_A142N_S 146C_D147Y_E155V_I156F_K157N), (H36L_P48A_R51L_L84F_A106V_D108N_H123Y_S 146C_D147Y_E155V_I156F_K157N), (H36L_P48A_R51L_L84F_A106V_D108N_H123Y_ A142N_S 146C_D147Y_E155V_I156F_K157N), (H36L_P48A_R51L_L84F_A106V_D108N_H123Y_S 146C_A142N_D147Y_E155V_I156F_K157N), (W23L_H36L_P48A_R51L_L84F_A106V_D108N_ H123Y_S 146C_D147Y_E155V_I156F_K157N), (W23R_H36L_P48A_R51L_L84F_A106V_D108N_ H123Y_S 146C_D147Y_E155V_I156F_K157N), (W23L_H36L_P48A_R51L_L84F_A106V_D108N_

H123Y_S            146R_D147Y_E155V_I156F_K161T),
(H36L_P48A_R51L_L84F_A106V_D108N_H123Y_S
146C_D147Y_R152H_E155V_I156F_K157N),
(H36L_P48A_R51L_L84F_A106V_D108N_H123Y_S
146C_D147Y_R152P_E155V_I156F_K157N),
(W23L_H36L_P48A_R51L_L84F_A106V_D108N_
H123Y_S  146C_D147Y_R152P_E155V_I156F_K157N),
(W23L_H36L_P48A_R51L_L84F_A106V_D108N_
H123Y_A142A_S  146C_D147Y_E155V_I156F_K157N),
(W23L_H36L_P48A_R51L_L84F_A106V_D108N_
H123Y_A142A_S
146C_D147Y_R152P_E155V_I156F_K157N),
(W23L_H36L_P48A_R51L_L84F_A106V_D108N_
H123Y_S            146R_D147Y_E155V_I156F_K161T),
(W23R_H36L_P48A_R51L_L84F_A106V_D108N_
H123Y_S  146C_D147Y_R152P_E155V_I156F_K157N),
(H36L_P48A_R51L_L84F_A106V_D108N_H123Y_
A142N_S 146C_D147Y_R152P_E155 V_I156F_K157N).

Cytidine Deaminase

In one embodiment, a fusion protein of the invention comprises a cytidine deaminase. In some embodiments, the cytidine deaminases provided herein are capable of deaminating cytosine or 5-methylcytosine to uracil or thymine. In some embodiments, the cytosine deaminases provided herein are capable of deaminating cytosine in DNA. The cytidine deaminase may be derived from any suitable organism. In some embodiments, the cytidine deaminase is a naturally-occurring cytidine deaminase that includes one or more mutations corresponding to any of the mutations provided herein. One of skill in the art will be able to identify the corresponding residue in any homologous protein, e.g., by sequence alignment and determination of homologous residues. Accordingly, one of skill in the art would be able to generate mutations in any naturally-occurring cytidine deaminase that corresponds to any of the mutations described herein. In some embodiments, the cytidine deaminase is from a prokaryote. In some embodiments, the cytidine deaminase is from a bacterium. In some embodiments, the cytidine deaminase is from a mammal (e.g., human).

In some embodiments, the cytidine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the cytidine deaminase amino acid sequences set forth herein. It should be appreciated that cytidine deaminases provided herein may include one or more mutations (e.g., any of the mutations provided herein). The disclosure provides any deaminase domains with a certain percent identity plus any of the mutations or combinations thereof described herein. In some embodiments, the cytidine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the cytidine deaminases provided herein. In some embodiments, the cytidine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

A fusion protein of the invention comprises a nucleic acid editing domain. In some embodiments, the nucleic acid editing domain can catalyze a C to U base change. In some embodiments, the nucleic acid editing domain is a deaminase domain. In some embodiments, the deaminase is a cytidine deaminase or an adenosine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3 A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is a *Petromyzon marinus* cytidine deaminase 1 (pmCDA1). In some embodiments, the deaminase is a human APOBEC3G. In some embodiments, the deaminase is a fragment of the human APOBEC3G. In some embodiments, the deaminase is a human APOBEC3G variant comprising a D316R D317R mutation. In some embodiments, the deaminase is a fragment of the human APOBEC3G and comprising mutations corresponding to the D316R D317R mutations. In some embodiments, the nucleic acid editing domain is at least 80%, at least 85%, at least 90%, at least 92%, at least 95%, at least 96%, at least 97%, at least 98%, at least 99%), or at least 99.5% identical to the deaminase domain of any deaminase described herein.

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

Cas9 Domains of Nucleobase Editors

In some aspects, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124).

```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHTIQDLTLLKALVRQQLPEKYKE

IFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFD

KNLPNEKVLPKHSLLYEYFTVYNELTKVKYVTEGMRKPAFLSGEQKKAIV

DLLFKTNRKVTVKQLKEDYFKKIECFDSVETSGVEDRFNASLGTYHDLLK

IIKDKDFLDNEENEDILEDIVLTLTLFEDREMIEERLKTYAHLFDDKVMK

QLKRRRYTGWGRLSRKLING1RDKQSGKTILDFLKSDGFANRNFMQLIHD

DSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEH

PVENTQLQNEKLYLYYLQNGRDMYVDQELDINRLSDYDVDAIVPQSFLKD

DSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKL
```

-continued

```
IREVKVITLKSKLVSDFRKDFQFYKVREINNYHHAHDAYLNAVVGTALIK

KYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKV

EKGKSKKLKSVKELLGITIMERSSFEKNPIDFLEAKGYKEVKKDLIIKLP

KYSLFELENGRKRMLASAGELQKGNELALPSKYVNFLYLASHYEKLKGSP

EDNEQKQLFVEQHKHYLDEIIEQISEFSKRVILADANLDKVLSAYNKHRD

KPIREQAENIIHLFTLTNLGAPAAFKYFDTTIDRKRYTSTKEVLDATLIH

QSITGLYETRIDLSQLGGD (see, e.g., Qi et at.,

"Repurposing CRISPR as an RNA-guided platform for sequence-specific control of gene expression."

Cell. 2013; 152(5):1173-83, the entire contents of which are incorporated herein by reference).
```

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology*. 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

Typically, Cas9 proteins, such as Cas9 from *S. pyogenes* (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference. Several PAM variants are described at Table 1 below:

TABLE 1

| Cas9 proteins and corresponding PAM sequences | |
|---|---|
| Variant | PAM |
| spCas9 | NGG |
| spCas9-VRQR | NGA |
| spCas9-VRER | NGCG |
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |
| Cpf1 | 5' (TTTV) |

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

```
Exemplary SaCas9 sequence
KRNYILGLDIGITSVGYGIIDYETRDVIDAGVRLFKEANVENNEGRRSKR

GARRLKRRRRIARIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEENSKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAEILDITDDYPN

SRNKVVKLSLKPYRFDVYLDNGVYKFVTVKNLDVIKKENYYEVNSKCYEE

AKKLKKISNQAEFIASFYNNDLIKINGELYRVIGVNNDLLNRIEVNMIDI

TYREYLENMNDKRPPRIIKTIASKTQSIKKYSTDILGNLYEVKSKKHPQI

IKKG

Residue N579 above, which is underlined and in bold, may be mutated (e.g., to a A579) to yield a SaCas9 nickase.

Exemplary SaCas9n sequence
KRNYILGLDIGITSVGYGIIDYETRDVIDAGYRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA
```

-continued

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSIIRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKBPQII

KKG

Residue A579 above, which can be mutated from N579 to yield a SaCas9 nickase, is underlined and in bold.

Exemplary SaKKH Cas9
KRNYILGLDIGITSVGYGIIDYETRDVIDAGVRLFKEANVENNEGRRSKR

GARRLKRRRRIARIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLEEDMQEGKCLYSLEAIPLEDLLNN

PFNYEVDHIIPRSVSFDNSFNNKVLVKQEEASKKGNRTPFQYLSSSDSKI

SYETFKKHILNLAKGKGRISKTKKEYLLEERDINRFSVQKDFINRNLVDT

RYATRGLMNLLRSYFRVNNLDVKVKSINGGFTSFLRRKWKFKKERNKGYK

EEHAEDALIIANADFIFKEWKKLDKAKKVMENQWEEKQAESMPEIETEQE

YKEIFITPHQIKHIKDFKDYKYSHRVDKKPNR*KL*INDTLYSTRKDDKGNT

LIVNNLNGLYDKDNDKLKKLINKSPEKLLMYHHDPQTYQKLKLIMEQYGD

EKNPLYKYYEETGNYLTKYSKKDNGPVIKKIKYYGNKLNAHLDITDDYPN

-continued

SRNKVVKLSLKPYRFDVYLDNGVYKFVTVKNLDVIKKENYYEVNSKCYEE

AKKLKKISNQAEFIASFY*KN*DLIKINGELYRVIGVNNDLLNRIEVNMIDI

TYREYLENMNDKRPP*HI*IKTIASKTQSIKKYSTDILGNLYEVKSKKHPQI

IKKG

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and in italics In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is any amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence. In some embodiments, the SpCas9 domain comprises one or more of a D1134X, a R1334X, and a T1336X mutation, or a corresponding mutation in any of the amino acid sequences provided herein, wherein X is any amino acid. In some embodiments, the SpCas9 domain comprises one or more of a D1134E, R1334Q, and T1336R mutation, or a corresponding mutation in any of the amino acid sequences provided herein. In some embodiments, the SpCas9 domain comprises a D1134E, a R1334Q, and a T1336R mutation, or corresponding mutations in any of the amino acid sequences provided herein. In some embodiments, the SpCas9 domain comprises one or more of a D1134X, a R1334X, and a T1336X mutation, or a corresponding mutation in any of the amino acid sequences provided herein, wherein X is any amino acid. In some embodiments, the SpCas9 domain comprises one or more of a D1134V, a R1334Q, and a T1336R mutation, or a corresponding mutation in any of the amino acid sequences provided herein. In some embodiments, the SpCas9 domain comprises a D1134V, a R1334Q, and a T1336R mutation, or corresponding mutations in any of the amino acid sequences provided herein. In some embodiments, the SpCas9 domain comprises one or more of a D1134X, a G1217X, a R1334X, and a T1336X mutation, or a corresponding mutation in any of the amino acid sequences provided herein, wherein X is any amino acid. In some embodiments, the SpCas9 domain comprises one or more of a D1134V, a G1217R, a R1334Q, and a T1336R mutation, or a corresponding mutation in any of the amino acid sequences provided herein. In some embodiments, the SpCas9 domain comprises a D1134V, a G1217R, a R1334Q, and a T1336R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

Exemplary SpCas9
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GREIKPENIVIEMARENQTTQKGQKNSRERMKRIEEGIKELGSQILKEEE

PVENTQLQNEKLYLYYLQNGRDMYVDQELDINRLSDYDVDHIVPQSFLKD

DSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKL

IREVKVITLKSKLVSDFRKDFQFYKVREINNYHHAHDAYLNAVVGTALIK

KYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKV

EKGKSKKLKSVKELLGITIMERSSFEKNPIDFLEAKGYKEVKKDLIIKLP

KYSLFELENGRKRMLASAGELQKGNELALPSKYVNFLYLASHYEKLKGSP

EDNEQKQLFVEQHKHYLDEIIEQISEFSKRVILADANLDKVLSAYNKHRD

KPIREQAENIIHLFTLTNLGAPAAFKYFDTTIDRKRYTSTKEVLDATLIH

QSITGLYETRIDLSQLGGD

Exemplary SpCas9n
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

-continued

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLYIEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKK1VIKNYWRQLLNAKLITQRKFD

NLTKAERGGLSELDKAGFIKRQLVETRQITKHVAQILDSRMNTKYDENDK

LIREVKVITLKSKLVSDFRKDFQFYKVREINNYHHAHDAYLNAVVGTALI

KKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKT

EVQTGGFSKESILPKRNSDKLIARKKDWDPKKYGGFDSPTVAYSVLVVAK

VEKGKSKKLKSVKELLGITIMERSSFEKNPIDFLEAKGYKEVKKDLIIKL

PKYSLFELENGRKRMLASAGELQKGNELALPSKYVNFLYLASHYEKLKGS

PEDNEQKQLFVEQHKHYLDEIIEQISEFSKRVILADANLDKVLSAYNKHR

DKPIREQAENIIHLFTLTNLGAPAAFKYFDTTIDRKRYTSTKEVLDATLI

HQSITGLYETRIDLSQLGGD

Exemplary SpEQRCas9
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLEIEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

-continued

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFESPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKQYRSTKEVLDATLIHQ

SITGLYETRIDLSQLGGD

Residues E1134, Q1334, and R1336 above, which can
be mutated from D1134, R1334, and T1336 to yield a
SpEQRCas9, are underlined and in bold.

Exemplary SpVQRCas9
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFIAR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHTIQDLTLLKALVRQQLPEKYKE

IFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFD

KNLPNEKVLPKHSLLYEYFTVYNELTKVKYVTEGMRKPAFLSGEQKKAIV

DLLFKTNRKVTVKQLKEDYFKKIECFDSVEISGVEDRFNASLGTYHDLLK

IIKDKDFLDNEENEDILEDIVLTLTLFEDREMIEERLKTYAHLFDDKVMK

QLKRRRYTGWGRLSRKLINGIRDKQSGKTILDFLKSDGFANRNFMQLIHD

DSLTFKEDIQKAQVSGQGDSLEIEHIANLAGSPAIKKGILQTVKVVDELV

KVMGRHKPENIVIEMARENQTTQKGQKNSRERMKRIEEGIKELGSQILKE

HPVENTQLQNEKLYLYYLQNGRDMYVDQELDINRLSDYDVDHIVPQSFLK

DDSIDNKVLTRSDKNRGKSDNVPSEEVVKKMKNYWRQLLNAKLITQRKFD

NLTKAERGGLSELDKAGFIKRQLVETRQITKHVAQILDSRIVINTKYDEN

DKLIREVKVITLKSKLVSDFRKDFQFYKVREINNYHHAHDAYLNAVVGTA

LIKKYPKLESEFVYGDYKVYDVRKMIAKSEQEIGKATAKYFFYSNIMNFF

KTEITLANGEIRKRPLIETNGETGEIVWDKGRDFATVRKVLSMPQVNIVK

KTEVQTGGFSKESILPKRNSDKLIARKKDWDPKKYGGFVSPTVAYSVLVV

AKVEKGKSKKLKSVKELLGITIMERSSFEKNPIDFLEAKGYKEVKKDLII

KLPKYSLFELENGRKRMLASAGELQKGNELALPSKYVNFLYLASHYEKLK

-continued

GSPEDNEQKQLFVEQHKHYLDEIIEQISEFSKRVILADANLDKVLSAYNK

HRDKPIREQAENIIHLFTLTNLGAPAAFKYFDTTIDRKQYRSTKEVLDAT

LIHQSITGLYETRIDLSQLGGD

Residues V1134, Q1334, and R1336 above, which can
be mutated from D1134, R1334, and T1336 to yield a
SpVQRCas9, are underlined and in bold.

Exemplary SpVRERCas9
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIEGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASARELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKEYRSTKEVLDATLIHQS

ITGLYETRIDLSQLGGD.

Residues V1134, R1217, Q1334, and R1336 above,
which can be mutated from D1134, G1217, R1334, and
T1336 to yield a SpVRERCas9, are underlined and in
bold.

The Cas9 nuclease has two functional endonuclease
domains: RuvC and HNH. Cas9 undergoes a conformational
change upon target binding that positions the nuclease
domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some cases, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)](e.g., (b+c)/(a+b+c), where "a" is the band intensity of DNA substrate and "b" and "c" are the cleavage products).

In some cases, efficiency can be expressed in terms of percentage of successful NHEJ. For example, a T7 endonuclease I assay can be used to generate cleavage products and the ratio of products to substrate can be used to calculate the percentage NHEJ. T7 endonuclease Icleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2}) \times 100$, where "a" is the band intensity of DNA substrate and "b" and "c" are the cleavage products (Ran et. al., 2013 Sep. 12; 154 (6):1380-9; and Ran et al., Nat Protoc. 2013 November; 8(11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most cases, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag.

In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some cases, Cas9 is a variant Cas9 protein. A variant Cas9 polypeptide has an amino acid sequence that is different by one amino acid (e.g., has a deletion, insertion, substitution, fusion) when compared to the amino acid sequence of a wild type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some cases, the variant Cas9 protein has no substantial nuclease activity. When a subject Cas9 protein is a variant Cas9 protein that has no substantial nuclease activity, it can be referred to as "dCas9."

In some cases, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some cases, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337(6096):816-21).

In some cases, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840)

mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some cases, a variant Cas9 protein has a reduced ability to cleave both the complementary and the non-complementary strands of a double stranded target DNA. As a non-limiting example, in some cases, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors H840A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors H840A, D10A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some cases, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1 does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins more similar to types I and III than from type II systems. Functional Cpf1 doesn't need the trans-activating CRISPR RNA (tracrRNA), therefore, only CRISPR (crRNA) is required. This benefits genome editing because Cpf1 is not only smaller than Cas9, but also it has a smaller sgRNA molecule (proximately half as many nucleotides as Cas9). The Cpf1-crRNA complex cleaves target DNA or RNA by identification of a proto-spacer adjacent motif 5'-YTN-3' in contrast to the G-rich PAM targeted by Cas9. After identification of PAM, Cpf1 introduces a sticky-end-like DNA double-stranded break of 4 or 5 nucleotides overhang.

Fusion Proteins Comprising Two napDNAbp, a Deaminase Domain

Some aspects of the disclosure provide fusion proteins comprising a napDNAbp domain having nickase activity (e.g., nCas domain) and a catalytically inactive napDNAbp (e.g., dCas domain) and a nucleobase editor (e.g., adenosine deaminase domain, cytidine deaminase domain), where at least the napDNAbp domains are joined by a linker. It should be appreciated that the Cas domains may be any of the Cas domains or Cas proteins (e.g., dCas9 and nCas9) provided herein. In some embodiments, any of the Cas domains, DNA binding protein domains, or Cas proteins include, without limitation, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. One example of a programmable polynucleotide-binding protein that has different PAM specificity than Cas9 is Clustered Regularly Interspaced Short Palindromic Repeats from *Prevotella* and *Francisella*1 (Cpf1). Similar to Cas9, Cpf1 is also a class 2 CRISPR effector. For example and without limitation, in some embodiments, the fusion protein comprises the structure, where the deaminase is adenosine deaminase or cytidine deaminase:

NH$_2$-[deaminase]-[nCas domain]-[dCas domain]-COOH;
NH$_2$-[deaminase]-[dCas domain]-[nCas domain]-COOH;
NH$_2$-[nCas domain]-[dCas domain]-[deaminase]-COOH;
NH$_2$-[dCas domain]-[nCas domain]-[deaminase]-COOH;
NH$_2$-[nCas domain]-[deaminase]-[dCas domain]-COOH;
NH$_2$-[dCas domain]-[deaminase]-[nCas domain]-COOH;

In some embodiments, the "-" used in the general architecture above indicates the presence of an optional linker. In some embodiments, the deaminase and a napDNAbp (e.g., Cas domain) are not joined by a linker sequence, but are directly fused. In some embodiments, a linker is present between the deaminase domain and the napDNAbp. In some embodiments, the deaminase or other nucleobase editor is directly fused to dCas and a linker joins dCas and nCas9. In some embodiments, the deaminase and the napDNAbps are fused via any of the linkers provided herein. For example, in some embodiments the deaminase and the napDNAbp are fused via any of the linkers provided below in the section entitled "Linkers". In some embodiments, the dCas domain and the deaminase are immediately adjacent and the nCas domain is joined to these domains (either 5' or 3') via a linker.

Fusion Proteins with Internal Insertions

The disclosure provides fusion proteins comprising a heterologous polypeptide fused to a nucleic acid program-mable nucleic acid binding protein, for example, a napD-NAbp. A heterologous polypeptide can be a polypeptide that is not found in the native or wild-type napDNAbp polypep-tide sequence. The heterologous polypeptide can be fused to the napDNAbp at a C-terminal end of the napDNAbp, an N-terminal end of the napDNAbp, or inserted at an internal location of the napDNAbp. In some embodiments, the heterologous polypeptide is inserted at an internal location of the napDNAbp.

In some embodiments, the heterologous polypeptide is a deaminase or a functional fragment thereof. For example, a fusion protein can comprise a deaminase flanked by an N-terminal fragment and a C-terminal fragment of a Cas9 polypeptide. The deaminase in a fusion protein can be a cytidine deaminase. The deaminase in a fusion protein can be an adenosine deaminase.

The deaminase can be a circular permutant deaminase. For example, the deaminase can be a circular permutant adenosine deaminase or a circular permutant cytidine deami-nase. In some embodiments, the deaminase is a circular permutant TadA, circularly permutated at amino acid residue 116 as numbered in the TadA reference sequence. In some embodiments, the deaminase is a circular permutant TadA, circularly permutated at amino acid residue 136 as num-bered in the TadA reference sequence. In some embodi-ments, the deaminase is a circular permutant TadA, circu-larly permutated at amino acid residue 65 as numbered in the TadA reference sequence.

The fusion protein can comprise more than one deami-nase. The fusion protein can comprise, for example, 1, 2, 3, 4, 5 or more deaminases. In some embodiments, the fusion protein comprises one deaminase. In some embodiments, the fusion protein comprises two deaminases. The two or more deaminases in a fusion protein can be an adenosine deami-nase, cytidine deaminase, or a combination thereof. The two or more deaminases can be homodimers. The two or more deaminases can be heterodimers. The two or more deami-nases can be inserted in tandem in the napDNAbp. In some embodiments, the two or more deaminases may not be in tandem in the napDNAbp.

In some embodiments, the napDNAbp in the fusion protein is a Cas9 polypeptide or a fragment thereof. The Cas9 polypeptide can be a variant Cas9 polypeptide. In some embodiments, the Cas9 polypeptide is a Cas9 nickase (nCas9) polypeptide or a fragment thereof. In some embodi-ments, the Cas9 polypeptide is a nuclease dead Cas9 (dCas9) polypeptide or a fragment thereof. The Cas9 polypeptide in a fusion protein can be a full-length Cas9 polypeptide. In some cases, the Cas9 polypeptide in a fusion protein may not be a full length Cas9 polypeptide. The Cas9 polypeptide can be truncated, for example, at a N-terminal or C-terminal end relative to a naturally-occurring Cas9 protein. The Cas9 polypeptide can be a circularly permuted Cas9 protein.

The Cas9 polypeptide can be a fragment, a portion, or a domain of a Cas9 polypeptide, that is still capable of binding the target polynucleotide and a guide nucleic acid sequence.

In some embodiments, the Cas9 polypeptide is a *Strep-tococcus pyogenes* Cas9 (SpCas9), *Staphylococcus aureus* Cas9 (SaCas9), *Streptococcus thermophilus* 1 Cas9 (St1Cas9), or fragments or variants thereof.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas9 polypeptide.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to the Cas9 amino acid sequence set forth in SEQ ID NO: 1.

The heterologous polypeptide (e.g., deaminase) can be inserted in the napDNAbp (e.g., Cas9) at a suitable location, for example, such that the napDNAbp retains its ability to bind the target polynucleotide and a guide nucleic acid. A deaminase can be inserted into a napDNAbp without com-promising function of the deaminase (e.g., base editing activity) or the napDNAbp (e.g., ability to bind to target nucleic acid and guide nucleic acid). A deaminase can be inserted in the napDNAbp at, for example, a disordered region or a region comprising a high temperature factor or B-factor as shown by crystallographic studies. Regions of a protein that are less ordered, disordered, or unstructured, for example solvent exposed regions and loops, can be used for insertion without compromising structure or function. A deaminase can be inserted in the napDNAbp in a flexible loop region or a solvent-exposed region. In some embodiments, the deaminase is inserted in a flexible loop of the Cas9 polypeptide.

In some embodiments, the insertion location of a deaminase is determined by B-factor analysis of the crystal structure of Cas9 polypeptide. In some embodiments, the deaminase is inserted in regions of the Cas9 polypeptide comprising higher than average B-factors (e.g., higher B factors compared to the total protein or the protein domain comprising the disordered region). B-factor or temperature factor can indicate the fluctuation of atoms from their average position (for example, as a result of temperature-dependent atomic vibrations or static disorder in a crystal lattice). A high B-factor (e.g., higher than average B-factor) for backbone atoms can be indicative of a region with relatively high local mobility. Such a region can be used for inserting a deaminase without compromising structure or function. A deaminase can be inserted at a location with a residue having a Ca atom with a B-factor that is 50%, 60%, 70%, 80%, 90%, 100%, 110%, 120%, 130%, 140%, 150%, 160%, 170%, 180%, 190%, 200%, or greater than 200% more than the average B-factor for the total protein. A deaminase can be inserted at a location with a residue having a Ca atom with a B-factor that is 50%, 60%, 70%, 80%, 90%, 100%, 110%, 120%, 130%, 140%, 150%, 160%, 170%, 180%, 190%, 200% or greater than 200% more than the average B-factor for a Cas9 protein domain comprising the residue. Cas9 polypeptide positions comprising a higher than average B-factor can include, for example, residues 768, 792, 1052, 1015, 1022, 1026, 1029, 1067, 1040, 1054, 1068, 1246, 1247, and 1248 as numbered in SEQ ID No:1. Cas9 polypeptide regions comprising a higher than average B-factor can include, for example, residues 792-872, 792-906, and 2-791 as numbered in SEQ ID No: 1.

A heterologous polypeptide (e.g., deaminase) can be inserted in the napDNAbp at an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in SEQ ID NO: 1, or a corresponding amino acid residue in another Cas9 polypeptide. In some embodiments, the heterologous polypeptide is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in SEQ ID NO: 1 or corresponding amino acid positions thereof. In some embodiments, the heterologous polypeptide is inserted between amino acid positions 769-770, 792-793, 793-794, 1016-1017, 1023-1024, 1027-1028, 1030-1031, 1041-1042, 1053-1054, 1055-1056, 1068-1069, 1069-1070, 1248-1249, or 1249-1250 as numbered in SEQ ID NO: 1 or corresponding amino acid positions thereof. In some embodiments, the heterologous polypeptide replaces an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in SEQ ID NO: 1, or a corresponding amino acid residue in another Cas9 polypeptide. It should be understood that the reference to SEQ ID NO:1 with respect to insertion positions is for illustrative purpose. The insertions as discussed herein are not limited to the Cas9 polypeptide sequence of SEQ ID NO: 1, but include insertion at corresponding locations in variant Cas9 polypeptides, for example a Cas9 nickase (nCas9), nuclease dead Cas9 (dCas9), a Cas9 variant lacking a nuclease domain, a truncated Cas9, or a Cas9 domain lacking partial or complete HNH domain.

A heterologous polypeptide (e.g., deaminase) can be inserted in the napDNAbp at an amino acid residue selected from the group consisting of: 768, 792, 1022, 1026, 1040, 1068, and 1247 as numbered in SEQ ID NO: 1, or a corresponding amino acid residue in another Cas9 polypeptide. In some embodiments, the heterologous polypeptide is inserted between amino acid positions 768-769, 792-793, 1022-1023, 1026-1027, 1029-1030, 1040-1041, 1068-1069, or 1247-1248 as numbered in SEQ ID NO: 1 or corresponding amino acid positions thereof. In some embodiments, the heterologous polypeptide is inserted between amino acid positions 769-770, 793-794, 1023-1024, 1027-1028, 1030-1031, 1041-1042, 1069-1070, or 1248-1249 as numbered in SEQ ID NO: 1 or corresponding amino acid positions thereof. In some embodiments, the heterologous polypeptide replaces an amino acid residue selected from the group consisting of: 768, 792, 1022, 1026, 1040, 1068, and 1247 as numbered in SEQ ID NO: 1, or a corresponding amino acid residue in another Cas9 polypeptide.

A heterologous polypeptide (e.g., deaminase) can be inserted in the napDNAbp at an amino acid residue shown in FIG. 4, FIG. 5, FIG. 6, or FIG. 7, or a corresponding amino acid residue in another Cas9 polypeptide. A heterologous polypeptide (e.g., deaminase) can be inserted in the napDNAbp at an amino acid residue selected from the group consisting of: 1002, 1003, 1025, 1052-1056, 1242-1247, 1061-1077, 943-947, 686-691, 569-578, 530-539, and 1060-1077 as numbered in SEQ ID NO: 1, or a corresponding amino acid residue in another Cas9 polypeptide. The deaminase can be inserted at the N-terminus or the C-terminus of the residue or replace the residue. In some embodiments, the deaminase is inserted at the C-terminus of the residue.

In some embodiments, an ABE (e.g., TadA) is inserted at an amino acid residue selected from the group consisting of: 1015, 1022, 1029, 1040, 1068, 1247, 1054, 1026, 768, 1067, 1248, 1052, and 1246 as numbered in SEQ ID NO: 1, or a corresponding amino acid residue in another Cas9 polypeptide. In some embodiments, an ABE (e.g., TadA) is inserted in place of residues 792-872, 792-906, or 2-791 as numbered in SEQ ID NO: 1, or a corresponding amino acid residue in another Cas9 polypeptide. In some embodiments, the ABE is inserted at the N-terminus of an amino acid selected from the group consisting of: 1015, 1022, 1029, 1040, 1068, 1247, 1054, 1026, 768, 1067, 1248, 1052, and 1246 as numbered in SEQ ID NO: 1, or a corresponding amino acid residue in another Cas9 polypeptide. In some embodiments, the ABE is inserted at the C-terminus of an amino acid selected from the group consisting of: 1015, 1022, 1029, 1040, 1068, 1247, 1054, 1026, 768, 1067, 1248, 1052, and 1246 as numbered in SEQ ID NO: 1, or a corresponding amino acid residue in another Cas9 polypeptide. In some embodiments, the ABE is inserted to replace an amino acid selected from the group consisting of: 1015, 1022, 1029, 1040, 1068, 1247, 1054, 1026, 768, 1067, 1248, 1052, and 1246 as numbered in SEQ ID NO: 1, or a corresponding amino acid residue in another Cas9 polypeptide.

In some embodiments, a CBE (e.g., APOBEC1) is inserted at an amino acid residue selected from the group consisting of: 1016, 1023, 1029, 1040, 1069, and 1247 as numbered in SEQ ID NO: 1, or a corresponding amino acid residue in another Cas9 polypeptide. In some embodiments, the ABE is inserted at the N-terminus of an amino acid selected from the group consisting of: 1016, 1023, 1029, 1040, 1069, and 1247 as numbered in SEQ ID NO: 1, or a corresponding amino acid residue in another Cas9 polypeptide. In some embodiments, the ABE is inserted at the C-terminus of an amino acid selected from the group consisting of: 1016, 1023, 1029, 1040, 1069, and 1247 as numbered in SEQ ID NO: 1, or a corresponding amino acid residue in another Cas9 polypeptide. In some embodiments, the ABE is inserted to replace an amino acid selected from the group consisting of: 1016, 1023, 1029, 1040, 1069, and 1247 as numbered in SEQ ID NO: 1, or a corresponding amino acid residue in another Cas9 polypeptide.

In some embodiments, the deaminase is inserted at amino acid residue 768 as numbered in SEQ ID NO: 1, or a corresponding amino acid residue in another Cas9 polypeptide. In some embodiments, the ABE is inserted at the N-terminus of amino acid 768 as numbered in SEQ ID NO: 1, or a corresponding amino acid residue in another Cas9 polypeptide. In some embodiments, the ABE is inserted at the C-terminus of amino acid 768 as numbered in SEQ ID NO: 1, or a corresponding amino acid residue in another Cas9 polypeptide. In some embodiments, the ABE is inserted to replace amino acid 768 as numbered in SEQ ID NO: 1, or a corresponding amino acid residue in another Cas9 polypeptide.

In some embodiments, the deaminase is inserted at amino acid residue 791 as numbered in SEQ ID NO: 1, or a corresponding amino acid residue in another Cas9 polypeptide. In some embodiments, the ABE is inserted at the N-terminus of amino acid 791 as numbered in SEQ ID NO: 1, or a corresponding amino acid residue in another Cas9 polypeptide. In some embodiments, the ABE is inserted at the C-terminus of amino acid 791 as numbered in SEQ ID NO: 1, or a corresponding amino acid residue in another Cas9 polypeptide. In some embodiments, the ABE is inserted to replace amino acid 791 as numbered in SEQ ID NO: 1, or a corresponding amino acid residue in another Cas9 polypeptide.

In some embodiments, the deaminase is inserted at amino acid residue 792 as numbered in SEQ ID NO: 1, or a corresponding amino acid residue in another Cas9 polypeptide. In some embodiments, the ABE is inserted at the N-terminus of amino acid 792 as numbered in SEQ ID NO: 1, or a corresponding amino acid residue in another Cas9 polypeptide. In some embodiments, the ABE is inserted at the C-terminus of amino acid 792 as numbered in SEQ ID NO: 1, or a corresponding amino acid residue in another Cas9 polypeptide. In some embodiments, the ABE is inserted to replace amino acid 792 as numbered in SEQ ID NO: 1, or a corresponding amino acid residue in another Cas9 polypeptide.

In some embodiments, the deaminase is inserted at amino acid residue 1016 as numbered in SEQ ID NO: 1, or a corresponding amino acid residue in another Cas9 polypeptide. In some embodiments, the ABE is inserted at the N-terminus of amino acid 1016 as numbered in SEQ ID NO: 1, or a corresponding amino acid residue in another Cas9 polypeptide. In some embodiments, the ABE is inserted at the C-terminus of amino acid 1016 as numbered in SEQ ID NO: 1, or a corresponding amino acid residue in another Cas9 polypeptide. In some embodiments, the ABE is inserted to replace amino acid 1016 as numbered in SEQ ID NO: 1, or a corresponding amino acid residue in another Cas9 polypeptide.

In some embodiments, the deaminase is inserted at amino acid residue 1022 as numbered in SEQ ID NO: 1, or a corresponding amino acid residue in another Cas9 polypeptide. In some embodiments, the ABE is inserted at the N-terminus of amino acid 1022 as numbered in SEQ ID NO: 1, or a corresponding amino acid residue in another Cas9 polypeptide. In some embodiments, the ABE is inserted at the C-terminus of amino acid 1022 as numbered in SEQ ID NO: 1, or a corresponding amino acid residue in another Cas9 polypeptide. In some embodiments, the ABE is inserted to replace amino acid 1022 as numbered in SEQ ID NO: 1, or a corresponding amino acid residue in another Cas9 polypeptide.

In some embodiments, the deaminase is inserted at amino acid residue 1023 as numbered in SEQ ID NO: 1, or a corresponding amino acid residue in another Cas9 polypeptide. In some embodiments, the ABE is inserted at the N-terminus of amino acid 1023 as numbered in SEQ ID NO: 1, or a corresponding amino acid residue in another Cas9 polypeptide. In some embodiments, the ABE is inserted at the C-terminus of amino acid 1023 as numbered in SEQ ID NO: 1, or a corresponding amino acid residue in another Cas9 polypeptide. In some embodiments, the ABE is inserted to replace amino acid 1023 as numbered in SEQ ID NO: 1, or a corresponding amino acid residue in another Cas9 polypeptide.

In some embodiments, the deaminase is inserted at amino acid residue 1026 as numbered in SEQ ID NO: 1, or a corresponding amino acid residue in another Cas9 polypeptide. In some embodiments, the ABE is inserted at the N-terminus of amino acid 1026 as numbered in SEQ ID NO: 1, or a corresponding amino acid residue in another Cas9 polypeptide. In some embodiments, the ABE is inserted at the C-terminus of amino acid 1026 as numbered in SEQ ID NO: 1, or a corresponding amino acid residue in another Cas9 polypeptide. In some embodiments, the ABE is inserted to replace amino acid 1026 as numbered in SEQ ID NO: 1, or a corresponding amino acid residue in another Cas9 polypeptide.

In some embodiments, the deaminase is inserted at amino acid residue 1029 as numbered in SEQ ID NO: 1, or a corresponding amino acid residue in another Cas9 polypeptide. In some embodiments, the ABE is inserted at the N-terminus of amino acid 1029 as numbered in SEQ ID NO: 1, or a corresponding amino acid residue in another Cas9 polypeptide. In some embodiments, the ABE is inserted at the C-terminus of amino acid 1029 as numbered in SEQ ID NO: 1, or a corresponding amino acid residue in another Cas9 polypeptide. In some embodiments, the ABE is inserted to replace amino acid 1029 as numbered in SEQ ID NO: 1, or a corresponding amino acid residue in another Cas9 polypeptide.

In some embodiments, the deaminase is inserted at amino acid residue 1040 as numbered in SEQ ID NO: 1, or a corresponding amino acid residue in another Cas9 polypeptide. In some embodiments, the ABE is inserted at the N-terminus of amino acid 140 as numbered in SEQ ID NO: 1, or a corresponding amino acid residue in another Cas9 polypeptide. In some embodiments, the ABE is inserted at the C-terminus of amino acid 1040 as numbered in SEQ ID NO: 1, or a corresponding amino acid residue in another Cas9 polypeptide. In some embodiments, the ABE is inserted to replace amino acid 1040 as numbered in SEQ ID NO: 1, or a corresponding amino acid residue in another Cas9 polypeptide.

In some embodiments, the deaminase is inserted at amino acid residue 1052 as numbered in SEQ ID NO: 1, or a corresponding amino acid residue in another Cas9 polypeptide. In some embodiments, the ABE is inserted at the N-terminus of amino acid 1052 as numbered in SEQ ID NO: 1, or a corresponding amino acid residue in another Cas9 polypeptide. In some embodiments, the ABE is inserted at the C-terminus of amino acid 1052 as numbered in SEQ ID NO: 1, or a corresponding amino acid residue in another Cas9 polypeptide. In some embodiments, the ABE is inserted to replace amino acid 1052 as numbered in SEQ ID NO: 1, or a corresponding amino acid residue in another Cas9 polypeptide.

In some embodiments, the deaminase is inserted at amino acid residue 1054 as numbered in SEQ ID NO: 1, or a corresponding amino acid residue in another Cas9 polypeptide. In some embodiments, the ABE is inserted at the N-terminus of amino acid 1054 as numbered in SEQ ID NO: 1, or a corresponding amino acid residue in another Cas9 polypeptide. In some embodiments, the ABE is inserted at the C-terminus of amino acid 1054 as numbered in SEQ ID NO: 1, or a corresponding amino acid residue in another Cas9 polypeptide. In some embodiments, the ABE is inserted to replace amino acid 1054 as numbered in SEQ ID NO: 1, or a corresponding amino acid residue in another Cas9 polypeptide.

In some embodiments, the deaminase is inserted at amino acid residue 1067 as numbered in SEQ ID NO: 1, or a corresponding amino acid residue in another Cas9 polypeptide. In some embodiments, the ABE is inserted at the N-terminus of amino acid 1067 as numbered in SEQ ID NO: 1, or a corresponding amino acid residue in another Cas9 polypeptide. In some embodiments, the ABE is inserted at the C-terminus of amino acid 1067 as numbered in SEQ ID NO: 1, or a corresponding amino acid residue in another Cas9 polypeptide. In some embodiments, the ABE is inserted to replace amino acid 1067 as numbered in SEQ ID NO: 1, or a corresponding amino acid residue in another Cas9 polypeptide.

In some embodiments, the deaminase is inserted at amino acid residue 1068 as numbered in SEQ ID NO: 1, or a corresponding amino acid residue in another Cas9 polypeptide. In some embodiments, the ABE is inserted at the N-terminus of amino acid 1068 as numbered in SEQ ID NO: 1, or a corresponding amino acid residue in another Cas9 polypeptide. In some embodiments, the ABE is inserted at the C-terminus of amino acid 1068 as numbered in SEQ ID NO: 1, or a corresponding amino acid residue in another Cas9 polypeptide. In some embodiments, the ABE is inserted to replace amino acid 1068 as numbered in SEQ ID NO: 1, or a corresponding amino acid residue in another Cas9 polypeptide.

In some embodiments, the deaminase is inserted at amino acid residue 1069 as numbered in SEQ ID NO: 1, or a corresponding amino acid residue in another Cas9 polypeptide. In some embodiments, the ABE is inserted at the N-terminus of amino acid 1069 as numbered in SEQ ID NO: 1, or a corresponding amino acid residue in another Cas9 polypeptide. In some embodiments, the ABE is inserted at the C-terminus of amino acid 1069 as numbered in SEQ ID NO: 1, or a corresponding amino acid residue in another Cas9 polypeptide. In some embodiments, the ABE is inserted to replace amino acid 1069 as numbered in SEQ ID NO: 1, or a corresponding amino acid residue in another Cas9 polypeptide.

In some embodiments, the deaminase is inserted at amino acid residue 1246 as numbered in SEQ ID NO: 1, or a corresponding amino acid residue in another Cas9 polypeptide. In some embodiments, the ABE is inserted at the N-terminus of amino acid 1246 as numbered in SEQ ID NO: 1, or a corresponding amino acid residue in another Cas9 polypeptide. In some embodiments, the ABE is inserted at the C-terminus of amino acid 1246 as numbered in SEQ ID NO: 1, or a corresponding amino acid residue in another Cas9 polypeptide. In some embodiments, the ABE is inserted to replace amino acid 1246 as numbered in SEQ ID NO: 1, or a corresponding amino acid residue in another Cas9 polypeptide.

In some embodiments, the deaminase is inserted at amino acid residue 1247 as numbered in SEQ ID NO: 1, or a corresponding amino acid residue in another Cas9 polypeptide. In some embodiments, the ABE is inserted at the N-terminus of amino acid 1247 as numbered in SEQ ID NO: 1, or a corresponding amino acid residue in another Cas9 polypeptide. In some embodiments, the ABE is inserted at the C-terminus of amino acid 1247 as numbered in SEQ ID NO: 1, or a corresponding amino acid residue in another Cas9 polypeptide. In some embodiments, the ABE is inserted to replace amino acid 1247 as numbered in SEQ ID NO: 1, or a corresponding amino acid residue in another Cas9 polypeptide.

In some embodiments, the deaminase is inserted at amino acid residue 1248 as numbered in SEQ ID NO: 1, or a corresponding amino acid residue in another Cas9 polypeptide. In some embodiments, the ABE is inserted at the N-terminus of amino acid 1248 as numbered in SEQ ID NO: 1, or a corresponding amino acid residue in another Cas9 polypeptide. In some embodiments, the ABE is inserted at the C-terminus of amino acid 1248 as numbered in SEQ ID NO: 1, or a corresponding amino acid residue in another Cas9 polypeptide. In some embodiments, the ABE is inserted to replace amino acid 1248 as numbered in SEQ ID NO: 1, or a corresponding amino acid residue in another Cas9 polypeptide.

In some embodiments, a heterologous polypeptide (e.g., deaminase) is inserted in a flexible loop of a Cas9 polypeptide. The flexible loop portions can be selected from the group consisting of 530-537, 569-570, 686-691, 943-947, 1002-1025, 1052-1077, 1232-1247, or 1298-1300 as numbered in SEQ ID NO: 1, or a corresponding amino acid residue in another Cas9 polypeptide. The flexible loop portions can be selected from the group consisting of: 1-529, 538-568, 580-685, 692-942, 948-1001, 1026-1051, 1078-1231, or 1248-1297 as numbered in SEQ ID NO: 1, or a corresponding amino acid residue in another Cas9 polypeptide.

A heterologous polypeptide (e.g., deaminase) can be inserted into a Cas9 polypeptide region corresponding to amino acid residues: 1017-1069, 1242-1247, 1052-1056, 1060-1077, 1002-1003, 943-947, 530-537, 568-579, 686-691, 1242-1247, 1298-1300, 1066-1077, 1052-1056, or 1060-1077 as numbered in SEQ ID NO: 1, or a corresponding amino acid residue in another Cas9 polypeptide.

A heterologous polypeptide (e.g., deaminase) can be inserted in place of a deleted region of a Cas9 polypeptide. The deleted region can correspond to an N-terminal or C-terminal portion of the Cas9 polypeptide. In some embodiments, the deleted region corresponds to residues 792-872 as numbered in SEQ ID NO: 1, or a corresponding amino acid residue in another Cas9 polypeptide. In some embodiments, the deleted region corresponds to residues 792-906 as numbered in SEQ ID NO: 1, or a corresponding amino acid residue in another Cas9 polypeptide. In some embodiments, the deleted region corresponds to residues 2-791 as numbered in SEQ ID NO: 1, or a corresponding amino acid residue in another Cas9 polypeptide. In some embodiments, the deleted region correspond to residues 1017-1069 as numbered in SEQ ID NO: 1, or corresponding amino acid residues thereof.

A heterologous polypeptide (e.g., deaminase) can be inserted within a structural or functional domain of a Cas9 polypeptide. A heterologous polypeptide (e.g., deaminase) can be inserted between two structural or functional domains of a Cas9 polypeptide. A heterologous polypeptide (e.g., deaminase) can be inserted in place of a structural or functional domain of a Cas9 polypeptide, for example, after deleting the domain from the Cas9 polypeptide. The structural or functional domains of a Cas9 polypeptide can include, for example, RuvC I, RuvC II, RuvC III, Rec1, Rec2, PI, or HNH.

In some embodiments, the Cas9 polypeptide lacks one or more domains selected from the group consisting of: RuvC I, RuvC II, RuvC III, Rec1, Rec2, PI, or HNH domain. In some embodiments, the Cas9 polypeptide lacks a nuclease domain. In some embodiments, the Cas9 polypeptide lacks a HNH domain. In some embodiments, the Cas9 polypeptide lacks a portion of the HNH domain such that the Cas9 polypeptide has reduced or abolished HNH activity.

In some embodiments, the Cas9 polypeptide comprises a deletion of the nuclease domain and the deaminase is inserted to replace the nuclease domain. In some embodiments, the HNH domain is deleted and the deaminase is inserted in its place. In some embodiments, one or more of the RuvC domains is deleted and the deaminase is inserted in its place.

A fusion protein comprising a heterologous polypeptide can be flanked by a N-terminal and a C-terminal fragment of a napDNAbp. In some embodiments, the fusion protein comprises a deaminase flanked by a N-terminal fragment and a C-terminal fragment of a Cas9 polypeptide. The N terminal fragment or the C terminal fragment can bind the target polynucleotide sequence. The C-terminus of the N terminal fragment or the N-terminus of the C terminal fragment can comprise a part of a flexible loop of a Cas9 polypeptide. The C-terminus of the N terminal fragment or the N-terminus of the C terminal fragment can comprise a part of an alpha-helix structure of the Cas9 polypeptide. The N-terminal fragment or the C-terminal fragment can comprise a DNA binding domain. The N-terminal fragment or the C-terminal fragment can comprise a RuvC domain. The N-terminal fragment or the C-terminal fragment can comprise a HNH domain. In some embodiments, neither of the N-terminal fragment and the C-terminal fragment comprises a HNH domain.

In some embodiments, the C-terminus of the N terminal Cas9 fragment comprises an amino acid that is in proximity to a target nucleobase when the fusion protein deaminates the target nucleobase. In some embodiments, the N-terminus of the C terminal Cas9 fragment comprises an amino acid that is in proximity to a target nucleobase when the fusion protein deaminates the target nucleobase. The insertion location of different deaminases can be different in order to have proximity between the target nucleobase and an amino acid in the C-terminus of the N terminal Cas9 fragment or the N-terminus of the C terminal Cas9 fragment. For example, the insertion position of an ABE can be at an amino acid residue selected from the group consisting of: 1015, 1022, 1029, 1040, 1068, 1247, 1054, 1026, 768, 1067, 1248, 1052, and 1246 as numbered in SEQ ID NO: 1, or a corresponding amino acid residue in another Cas9 polypeptide. A suitable insertion position of a CBE can be an amino acid residue selected from the group consisting of: 1016, 1023, 1029, 1040, 1069, and 1247 as numbered in SEQ ID NO: 1, or a corresponding amino acid residue in another Cas9 polypeptide. In certain embodiments, the insertion of the ABE can be inserted to the N terminus or the C terminus of any one of the above listed amino acid residues. In some embodiments, the insertion of the ABE can be inserted to replace any one of the above listed amino acid residues.

The N-terminal Cas9 fragment of a fusion protein (i.e. the N-terminal Cas9 fragment flanking the deaminase in a fusion protein) can comprise the N-terminus of a Cas9 polypeptide. The N-terminal Cas9 fragment of a fusion protein can comprise a length of at least about: 100, 200, 300, 400, 500, 600, 700, 800, 900, 1000, 1100, 1200, or 1300 amino acids. The N-terminal Cas9 fragment of a fusion protein can comprise a sequence corresponding to amino acid residues: 1-56, 1-95, 1-200, 1-300, 1-400, 1-500, 1-600, 1-700, 1-718, 1-765, 1-780, 1-906, 1-918, or 1-1100 as numbered in SEQ ID NO: 1, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1-56, 1-95, 1-200, 1-300, 1-400, 1-500, 1-600, 1-700, 1-718, 1-765, 1-780, 1-906, 1-918, or 1-1100 as numbered in SEQ ID NO: 1, or a corresponding amino acid residue in another Cas9 polypeptide.

The C-terminal Cas9 fragment of a fusion protein (i.e. the C-terminal Cas9 fragment flanking the deaminase in a fusion protein) can comprise the C-terminus of a Cas9 polypeptide. The C-terminal Cas9 fragment of a fusion protein can comprise a length of at least about: 100, 200, 300, 400, 500, 600, 700, 800, 900, 1000, 1100, 1200, or 1300 amino acids. The C-terminal Cas9 fragment of a fusion protein can comprise a sequence corresponding to amino acid residues: 1099-1368, 918-1368, 906-1368, 780-1368, 765-1368, 718-1368, 94-1368, or 56-1368 as numbered in SEQ ID NO: 1, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1099-1368, 918-1368, 906-1368, 780-1368, 765-1368, 718-1368, 94-1368, or 56-1368 as numbered in SEQ ID NO: 1, or a corresponding amino acid residue in another Cas9 polypeptide.

The N-terminal Cas9 fragment and C-terminal Cas9 fragment of a fusion protein taken together may not correspond to a full-length naturally occurring Cas9 polypeptide sequence, for example, as set forth in SEQ ID NO: 1.

The fusion protein described herein can effect targeted deamination with reduced deamination at non-target sites (e.g., off-target sites), such as reduced genome wide spurious deamination. The fusion protein described herein can effect targeted deamination with reduced bystander deamination at non-target sites. The undesired deamination or off-target deamination can be reduced by at least 30%, at least 40%, at least 50%, at least 60%, at least 70%, at least 80%, at least 90%, at least 95%, or at least 99% compared with, for example, an end terminus fusion protein comprising the deaminase fused to a N terminus or a C terminus of a Cas9 polypeptide. The undesired deamination or off-target deamination can be reduced by at least one-fold, at least two-fold, at least three-fold, at least four-fold, at least five-fold, at least tenfold, at least fifteen fold, at least twenty fold, at least thirty fold, at least forty fold, at least fifty fold, at least 60 fold, at least 70 fold, at least 80 fold, at least 90 fold, or at least hundred fold, compared with, for example, an end terminus fusion protein comprising the deaminase fused to a N terminus or a C terminus of a Cas9 polypeptide.

In some embodiments, the deaminase of the fusion protein deaminates no more than two nucleobases within the range of a R-loop. In some embodiments, the deaminase of the fusion protein deaminates no more than three nucleobases within the range of the R-loop. In some embodiments, the deaminase of the fusion protein deaminates no more than 2, 3, 4, 5, 6, 7, 8, 9, or 10 nucleobases within the range of the R-loop. A R-loop is a three-stranded nucleic acid structure including a DNA:RNA hybrid, a DNA:DNA or a RNA:RNA complementary structure and the associated with single-stranded DNA. As used herein, a R-loop may be formed when a target polynucleotide is contacted with a CRISPR complex or a base editing complex, wherein a portion of a guide polynucleotide, e.g. a guide RNA, hybridizes with and displaces with a portion of a target polynucleotide, e.g. a target DNA. In some embodiments, a R-loop comprises a hybridized region of a spacer sequence and a target DNA complementary sequence. A R-loop region may be of about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleobase pairs in length. In some embodiments, the R-loop region is about 20 nucleobase pairs in length. It should be understood that, as used herein, a R-loop region is not limited to the target DNA strand that hybridizes with the guide polynucleotide. For example, editing of a target nucleobase within a R-loop region may be to a DNA strand that comprises the complementary strand to a guide RNA or may be to a DNA strand that is the opposing strand of the strand complementary to the guide RNA. In some embodiments, editing in the region of the R-loop comprises editing a nucleobase on non-complementary strand (protospacer strand) to a guide RNA in a target DNA sequence.

The fusion protein described herein can effect target deamination in an editing window different from canonical base editing. In some embodiments, a target nucleobase is from about 1 to about 20 bases upstream of a PAM sequence in the target polynucleotide sequence. In some embodiments, a target nucleobase is from about 2 to about 12 bases upstream of a PAM sequence in the target polynucleotide sequence. In some embodiments, a target nucleobase is from about 1 to 9 base pairs, about 2 to 10 base pairs, about 3 to 11 base pairs, about 4 to 12 base pairs, about 5 to 13 base pairs, about 6 to 14 base pairs, about 7 to 15 base pairs, about 8 to 16 base pairs, about 9 to 17 base pairs, about 10 to 18 base pairs, about 11 to 19 base pairs, about 12 to 20 base pairs, about 1 to 7 base pairs, about 2 to 8 base pairs, about 3 to 9 base pairs, about 4 to 10 base pairs, about 5 to 11 base pairs, about 6 to 12 base pairs, about 7 to 13 base pairs, about 8 to 14 base pairs, about 9 to 15 base pairs, about 10 to 16 base pairs, about 11 to 17 base pairs, about 12 to 18 base pairs, about 13 to 19 base pairs, about 14 to 20 base pairs, about 1 to 5 base pairs, about 2 to 6 base pairs, about 3 to 7 base pairs, about 4 to 8 base pairs, about 5 to 9 base pairs, about 6 to 10 base pairs, about 7 to 11 base pairs, about 8 to 12 base pairs, about 9 to 13 base pairs, about 10 to 14 base pairs, about 11 to 15 base pairs, about 12 to 16 base pairs, about 13 to 17 base pairs, about 14 to 18 base pairs, about 15 to 19 base pairs, about 16 to 20 base pairs, about 1 to 3 base pairs, about 2 to 4 base pairs, about 3 to 5 base pairs, about 4 to 6 base pairs, about 5 to 7 base pairs, about 6 to 8 base pairs, about 7 to 9 base pairs, about 8 to 10 base pairs, about 9 to 11 base pairs, about 10 to 12 base pairs, about 11 to 13 base pairs, about 12 to 14 base pairs, about 13 to 15 base pairs, about 14 to 16 base pairs, about 15 to 17 base pairs, about 16 to 18 base pairs, about 17 to 19 base pairs, about 18 to 20 base pairs away or upstream of the PAM sequence. In some embodiments, a target nucleobase is about 1, 2, 3, 4, 5, 6, 7, 8, 9, 10, 11, 12, 13, 14, 15, 16, 17, 18, 19, 20, or more base pairs away or upstream of the PAM sequence. In some embodiments, a target nucleobase is about 1, 2, 3, 4, 5, 6, 7, 8, or 9 base pairs upstream of the PAM sequence. In some embodiments, a target nucleobase is about 2, 3, 4, or 6 base pairs upstream of the PAM sequence.

Accordingly, also provided herein are fusion protein libraries and method for using same to optimize base editing that allow for alternative preferred base editing windows compared to canonical base editors, e.g. BE4. In some embodiments, the disclosure provides a protein library for optimized base editing comprising a plurality of fusion proteins, wherein each one of the plurality of fusion proteins comprises a deaminase flanked by a N-terminal fragment and a C-terminal fragment of a Cas9 polypeptide, wherein the N-terminal fragment of each one of the fusion proteins differs from the N-terminal fragments of the rest of the plurality of fusion proteins or wherein the C-terminal fragment of each one of the fusion proteins differs from the C-terminal fragments of the rest of the plurality of fusion proteins, wherein the deaminase of each one of the fusion proteins deaminates a target nucleobase in proximity to a Protospacer Adjacent Motif (PAM) sequence in a target polynucleotide sequence, and wherein the N terminal fragment or the C terminal fragment binds the target polynucleotide sequence. In some embodiments, for each nucleobase within a CRISPR R-loop, at least one of the plurality of fusion proteins deaminates the nucleobase. In some embodiments, for each nucleobase within of a target polynucleotide from 1 to 20 base pairs away of a PAM sequence, at least one of the plurality of fusion proteins deaminates the nucleobase. In some embodiments, provided herein is a kit comprising the fusion protein library that allows for optimized base editing.

The fusion protein can comprise more than one heterologous polypeptide. For example, the fusion protein can additionally comprise one or more UGI domains and/or one or more nuclear localization signals. The two or more heterologous domains can be inserted in tandem. The two or more heterologous domains can be inserted at locations such that they are not in tandem in the NapDNAbp.

A fusion protein can comprise a linker between the deaminase and the napDNAbp polypeptide. The linker can be a peptide or a non-peptide linker. For example, the linker can be an XTEN, (GGGS)n (SEQ ID NO: 106), (GGGGS)n (SEQ ID NO: 107), (G)n, (EAAAK)n (SEQ ID NO: 108), (GGS)n, SGSETPGTSESATPES (SEQ ID NO: 8). In some embodiments, the fusion protein comprises a linker between the N-terminal Cas9 fragment and the deaminase. In some embodiments, the fusion protein comprises a linker between the C-terminal Cas9 fragment and the deaminase. In some embodiments, the N-terminal and C-terminal fragments of napDNAbp are connected to the deaminase with a linker. In some embodiments, the N-terminal and C-terminal fragments are joined to the deaminase domain without a linker. In some embodiments, the fusion protein comprises a linker between the N-terminal Cas9 fragment and the deaminase, but does not comprise a linker between the C-terminal Cas9 fragment and the deaminase. In some embodiments, the fusion protein comprises a linker between the C-terminal Cas9 fragment and the deaminase, but does not comprise a linker between the N-terminal Cas9 fragment and the deaminase. Exemplary TadA or TadA7.10 sequence set forth below:

```
SEVEFSHEYWMRHALTLAKRARDEREVPVGAVLVLNNRVIGEGWNRAIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

PRQVFNAQKKAQSSTD

GSSGSETPGTSESATPESSGSEVEFSHEYWMRHALTLAKRARDEREVPVG

AVLVLNNRVIGEGWNRAIGLEMPTAHAEIMALRQGGLVMQNYRLIDATLY

VTFEPCVMCAGAMIHSRIGRVVFGVRNAKTGAAGSLMDVLHYPGMNHRVE

ITEGILADECAALLCYFFRMPRQVFNAQKKAQSSTD

TAHAEIMALRQGGLVMQNYRLIDATLYVTFEPCVMCAGAMIHSRIGRVVF

GVRNAKTGAAGSLMDVLHYPGMNHRVEITEGILADECAALLCYFFRMPRQ

VFNAQKKAQSSTDGSSGSETPGTSESATPESSGSEVEFSHEYWMRHALTL

AKRARDEREVPVGAVLVLNNRVIGEGWNRAIGLEEDP

YRLIDATLYVTFEPCVMCAGAMIHSRIGRVVFGVRNAKTGAAGSLMDVLH

YPGMNURVEITEGILADECAALLCYFFRMPRQVFNAQKKAQSSTDGSSGS

ETPGTSESATPESSGSEVEFSHEYWMRHALTLAKRARDEREVPVGAVLVL

NNRVIGEGWNRAIGLHDPTAHAEIMALRQGGLVMQN

MNHRVEITEGILADECAALLCYFFRMPRQVFNAQKKAQSSTDGSSGSETP

GTSESATPESSGSEVEFSHEYWMRHALTLAKRARDEREVPVGAVLVLNNR

VIGEGWNRAIGLHDPTAHAEIMALRQGGLVMQNYRLIDATLYVTFEPCVM

CAGAMIHSRIGRVVFGVRNAKTGAAGSLMDVLHYPG

GSSGSETPGTSESATPESSGSEVEFSHEYWMRHALTLAKRARDEREVPVG

AVLVLNNRVIGEGWNRAIGLHDPTAHAEIMALRQGGLVMQNYRLIDATLY

VTFEPCVMCAGAMIHSRIGRVVFGVRNAKTGAAGSLMDVLHYPGMNHRVE

ITEGILADECAALLCYFFRMPRQVFN

GSSGSETPGTSESATPESSGSEVEFSHEYWMRHALTLAKRARDEREVPVG

AVLVLNNRVIGEGWNRAIGLEMPTAHAEIMALRQGGLVMQNYRLIDATLY

VTFEPCVMCAGAMIHSRIGRVVFGVRNAKTGAAGSLMDVLHYPGMNHRVE

ITEGILADECAALLCYFFRMPRQ

GSSGSETPGTSESATPESSGSEVEFSHEYWMRHALTLAKRARDEREVPVG

AVLVLNNRVIGEGWNRAHAEIMALRQGGLVMQNYRLIDATLYVTFEPCVM

CAGAMIHSRIGRVVFGVRNAKTGAAGSLMDVLHYPGMNHRVEITEGILAD

ECAALLCYFFRMPRQVFN

GSSGSETPGTSESATPESSGSEVEFSHEYWMRHALTLAKRARDEREVPVG

AVLVLNNRVIGEGWNRAHAEIMALRQGGLVMQNYRLIDATLYVTFEPCVM

CAGAMIHSRIGRVVFGVRNAKTGAAGSLMDVLHYPGMNHRVEITEGILAD

ECAALLCYFFRMPRQVFNAQKKAQSSTD

101 Cas9 TadAins 1015
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR
```

-continued

```
LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVGSSGSETPGTSESATPESSGSEVEFSHEYWMRHAL

TLAKRARDEREVPVGAVLVLNNRVIGEGWNRAIGLHDPTAHAEIMALRQG

GLVMQNYRLIDATLYVTFEPCVMCAGAMIHSRIGRVVFGVRNAKTGAAGS

LMDVLHYPGMNHRVEITEGILADECAALLCYFFRMPRQVFNAQKKAQSST

DYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

102 Cas9 TadAins 1022
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK
```

-continued

```
NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIGSSGSETPGTSESATPESSGSEVEFSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADECAALLCYFFRMPRQVFNAQ

KKAQSSTDAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

103 Cas9 TadAins 1029
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKP1LEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL
```

-continued

```
TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGSSGSETPGTSESATPESSGS

EVEFSHEYWMRHALTLAKRARDEREVPVGAVLVLNNRVIGEGWNRAIGLH

DPTAHAEIMALRQGGLVMQNYRLIDATLYVTFEPCVMCAGAMIHSRIGRV

VFGVRNAKTGAAGSLMDVLHYPGMNHRVEITEGILADECAALLCYFFRMP

RQVFNAQKKAQSSTDGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIBRKRYTSTKEVLDATLIHQSITGLYETRIDLSQ

LGGD

103 Cas9 TadAins 1040
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSGSSGSETPGT

SESATPESSGSEVEFSHEYWMRHALTLAKRARDEREVPVGAVLVLNNRVI

GEGWNRAIGLHDPTAHAEIMALRQGGLVMQNYRLIDATLYVTFEPCVMCA

GAMIHSRIGRVVFGVRNAKTGAAGSLMDVLHYPGMNHRVEITEGILADEC

AALLCYFFRMPRQVFNAQKKAQSSTDNIMNFFKTEITLANGEIRKRPLIE

TNGETGEIVWDKGRDFATVRKVLSMPQVNIVKKTEVQTGGFSKESILPKR
```

-continued

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

105 Cas9 TadAins 1068
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHRQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGEGSSGSETPGTSESATPESSGSEVEFSHEYWMR

HALTLAKRARDEREVPVGAVLVLNNRVIGEGWNRAIGLHDPTAHAEIMAL

RQGGLVMQNYRLIDATLYVTFEPCVMCAGAMIHSRIGRVVFGVRNAKTGA

AGSLMDVLHYPGMNHRVEITEGILADECAALLCYFFRMPRQVFNAQKKAQ

SSTDTGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

-continued

106 Cas9 TadAins 1247
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGGSS

GSETPGTSESATPESSGSEVEFSHEYWMRHALTLAKRARDEREVPVGAVL

VLNNRVIGEGWNRAIGLHDPTAHAEIMALRQGGLVMQNYRLIDATLYVTF

EPCVMCAGAMIHSRIGRVVFGVRNAKTGAAGSLMDVLHYPGMNHRVEITE

GILADECAALLCYFFRMPRQVFNAQKKAQSSTDSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

107 Cas9 TadAins 1054
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

-continued

```
KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGSSGSETPGTSESATPESSGSEVEFSHEYWMRHALTLAKRARDERE

VPVGAVLVLNNRVIGEGWNRAIGLHDPTAHAEIMALRQGGLVMQNYRLID

ATLYVTFEPCVMCAGAMIHSRIGRVVFGVRNAKTGAAGSLMDVLHYPGMN

HRVEITEGILADECAALLCYFFRMPRQVFNAQKKAQSSTDGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

108 Cas9 TadAins 1026
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP
```

-continued

```
VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEGSSGSETPGTSESATPESSGSEVE

FSHEYWMRHALTLAKRARDEREVPVGAVLVLNNRVIGEGWNRAIGLHDPT

AHAEIMALRQGGLVMQNYRLIDATLYVTFEPCVMCAGAMIHSRIGRVVFG

VRNAKTGAAGSLMDVLHYPGMNHRVEITEGILADECAALLCYFFRMPRQV

FNAQKKAQSSTDQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

109 Cas9 TadAins 768
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQSSSGSETPGTSESATPESSGSEVEFSHEYWMR

HALTLAKRARDEREVPVGAVLVLNNRVIGEGWNRAIGLHDPTAHAEIMAL

RQGGLVMQNYRLIDATLYVTFEPCVMCAGAMIHSRIGRVVFGVRNAKTGA

AGSLMDVLHYPGMNHRVEITEGILADECAALLCYFFRMPRTTQKGQKNSR

ERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQIT

KHVAQILDSRMNTKYDENDKLIREVKVITLKSKLVSDFRKDFQFYKVREI

NNYHHAHDAYLNAVVGTALIKKYPKLESEFVYGDYKVYDVRKMIAKSEQE
```

-continued

IGKATAKYFFYSNIMNFFKTEITLANGEIRKRPLIETNGETGEIVWDKGR

DFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNP

IDFLEAKGYKEVKKDLI1KLPKYSLFELENGRKRMLASAGELQKGNELAL

PSKYVNFLYLASHYEKLKGSPEDNEQKQLFVEQHKHYLDEIIEQISEFSK

RVILADANLDKVLSAYNKHRDKPIREQAENIIHLFTLTNLGAPAAFKYFD

TTIDRKRYTSTKEVLDATLIHQSITGLYETRIDLSQLGGD 110.1 Cas9 TadAins 1250
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPG

SSGSETPGTSESATPESSGSEVEFSHEYWMRHALTLAKRARDEREVPVGA

VLVLNNRVIGEGWNRAIGLHDPTAHAEIMALRQGGLVMQNYRLIDATLYV

TFEPCVMCAGAMIHSRIGRVVFGVRNAKTGAAGSLMDVLHYPGMNHRVEI

TEGILADECAALLCYFFRMPREDNEQKQLFVEQHKHYLDEIIEQISEFSK

RVILADANLDKVLSAYNKHRDKPIREQAENIIHLFTLTNLGAPAAFKYFD

TTIDRKRYTSTKEVLDATLIHQSITGLYETRIDLSQLGGD

-continued 110.2 Cas9 TadAins 1250
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKP1LEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPG

SSGSSGSETPGTSESATPESSGSEVEFSHEYWMRHALTLAKRARDEREVP

VGAVLVLNNRVIGEGWNRAIGLHDPTAHAEIMALRQGGLVMQNYRLIDAT

LYVTFEPCVMCAGAMIHSRIGRVVFGVRNAKTGAAGSLMDVLHYPGMNHR

VEITEGILADECAALLCYFFRMPREDNEQKQLFVEQHKHYLDEIIEQISE

FSKRVILADANLDKVLSAYNKHRDKPIREQAENIIHLFTLTNLGAPAAFK

YFDTTIDRKRYTSTKEVLDATLIHQSITGLYETRIDLSQLGGD 110.3 Cas9 TadAins 1250
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

-continued

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIEDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPG

SSGSSGSETPGTSESATPESGSSSGSEVEFSHEYWMRHALTLAKRARDER

EVPVGAVLVLNNRVIGEGWNRAIGLHDPTAHAEIMALRQGGLVMQNYRLI

DATLYVTFEPCVMCAGAMIHSRIGRVVFGVRNAKTGAAGSLMDVLHYPGM

NHRVEITEGILADECAALLCYFFRMPREDNEQKQLFVEQHKHYLDEIIEQ

ISEFSKRVILADANLDKVLSAYNKHRDKPIREQAENIIHLFTLTNLGAPA

AFKYFDTTIDRKRYTSTKEVLDATLIHQSITGLYETRIDLSQLGGD 110.4 Cas9 TadAins 1250
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEG1KELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

-continued

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPG

SSGSSGSETPGTSESATPESGSSSGSEVEFSHEYWMRHALTLAKRARDER

EVPVGAVLVLNNRVIGEGWNRAIGLHDPTAHAEIMALRQGGLVMQNYRLI

DATLYVTFEPCVMCAGAMIHSRIGRVVFGVRNAKTGAAGSLMDVLHYPGM

NHRVEITEGILADECAALLCYFFRMRREDNEQKQLFVEQHKHYLDEIIEQ

ISEFSKRVILADANLDKVLSAYNKHRDKPIREQAENIIHLFTLTNLGAPA

AFKYFDTTIDRKRYTSTKEVLDATLIHQSITGLYETRIDLSQLGGD 110.5 Cas9 TadAins 1249
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSGS

SGSSGSETPGTSESATPESGSSSGSEVEFSHEYWMRHALTLAKRARDERE

VPVGAVLVLNNRVIGEGWNRAIGLHDPTAHAEIMALRQGGLVMQNYRLID

ATLYVTFEPCVMCAGAMIHSRIGRVVFGVRNAKTGAAGSLMDVLHYPGMN

HRVEITEGILADECAALLCYFFRMRRPEDNEQKQLFVEQHKHYLDEIIEQ

ISEFSKRVILADANLDKVLSAYNKHRDKPIREQAENIIHLFTLTNLGAPA

AFKYFDTTIDRKRYTSTKEVLDATLIHQSITGLYETRIDLSQLGGD 110.5 Cas9 TadAins delta 59-66 1250
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPG

SSGSSSGSETPGTSESATPESGSSSGSEVEFSHEYWMRHALTLAKRARDERE

VPVGAVLVLNNRVIGEGWNRAHAEIMALRQGGLVMQNYRLIDATLYVTFE

PCVMCAGAMIHSRIGRVVFGVRNAKTGAAGSLMDVLHYPGMNHRVEITEG

ILADECAALLCYFFRMPRQVFNAQKKAQSSTDEDNEQKQLFVEQHKHYLD

EIIEQISEFSKRVILADANLDKVLSAYNKHRDKPIREQAENIIHLFTLTN

LGAPAAFKYFDTTIDRKRYTSTKEVLDATLIHQSITGLYETRIDLSQLGG

D 110.6 Cas9 TadAins 1251
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

-continued

```
IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DGSSGSSGSETPGTSESATPESGSSSGSEVEFSHEYWMRHALTLAKRARD

EREVPVGAVLVLNNRVIGEGWNRAIGLHDPTAHAEIMALRQGGLVMQNYR

LIDATLYVTFEPCVMCAGAMIHSRIGRVVFGVRNAKTGAAGSLMDVLHYP

GMNHRVEITEGILADECAALLCYFFRMRRNEQKQLFVEQHKHYLDEIIEQ

ISEFSKRVILADANLDKVLSAYNKHRDKPIREQAENIIHLFTLTNLGAPA

AFKYFDTTIDRKRYTSTKEVLDATLIHQSITGLYETRIDLSQLGGD
```

110.8 Cas9 TadAins delta 59-66 C-truncate 1250
```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI
```

-continued

```
TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPG

SSGSETPGTSESATPESSGSEVEFSHEYWMRHALTLAKRARDEREVPVGA

VLVLNNRVIGEGWNRAHAEIMALRQGGLVMQNYRLIDATLYVTFEPCVMC

AGAMIHSRIGRVVFGVRNAKTGAAGSLMDVLHYPGMNHRVEITEGILADE

CAALLCYFFRMPRQEDNEQKQLFVEQHKHYLDEIIEQISEFSKRVILADA

NLDKVLSAYNKHRDKPIREQAENIIHLFTLTNLGAPAAFKYFDTTIDRKR

YTSTKEVLDATLIHQSITGLYETRIDLSQLGGD
```

111.1 Cas9 TadAins 997
```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADECAALLCYFFRMPRQVFNAQ

KKAQSSTDGSSGSETPGTSESATPESSGIKKYPKLESEFVYGDYKVYDVR

KMIAKSEQEIGKATAKYFFYSNIMNFFKTEITLANGEIRKRPLIETNGET

GEIVWDKGRDFATVRKVLSMPQVNIVKKTEVQTGGFSKESILPKRNSDKL

IARKKDWDPKKYGGFDSPTVAYSVLVVAKVEKGKSKKLKSVKELLGITIM

ERSSFEKNPIDFLEAKGYKEVKKDLIIKLPKYSLFELENGRKRMLASAGE
```

-continued

LQKGNELALPSKYVNFLYLASHYEKLKGSPEDNEQKQLFVEQHKHYLDEI

IEQISEFSKRVILADANLDKVLSAYNKHRDKPIREQAENIIHLFTLTNLG

APAAFKYFDTTIDRKRYTSTKEVLDATLIHQSITGLYETRIDLSQLGGD 111.2 Cas9 TadAins 997
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADECAALLCYFFRMPRQVFNAQ

KKAQSSTDGSSGSSSGSETPGTSESATPESSGGSSIKKYPKLESEFVYGDY

KVYDVRKMIAKSEQEIGKATAKYFFYSNIMNFFKTEITLANGEIRKRPLI

ETNGETGEIVWDKGRDFATVRKVLSMPQVNIVKKTEVQTGGFSKESILPK

RNSDKLIARKKDWDPKKYGGFDSPTVAYSVLVVAKVEKGKSKKLKSVKEL

LGITIMERSSFEKNPIDFLEAKGYKEVKKDLIIKLPKYSLFELENGRKRM

LASAGELQKGNELALPSKYVNFLYLASHYEKLKGSPEDNEQKQLFVEQHK

HYLDEIIEQISEFSKRVILADANLDKVLSAYNKHRDKPIREQAENIIHLF

TLTNLGAPAAFKYFDTTIDRKRYTSTKEVLDATLIHQSITGLYETRIDLS

QLGGD 112 delta HNH TadA
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

-continued

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREK1EKILTFRIPY

YVGPLARGNSRFAWMTRKSEETITPWNFEEVVDKGASAQSF1ERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSEVEFSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADECAALLCYFFRMPRQVFNAQ

KKAQSSTDGGLSELDKAGFIKRQLVETRQITKHVAQILDSRMNTKYDEND

KLIREVKVITLKSKLVSDFRKDFQFYKVREINNYHHAHDAYLNAVVGTAL

IKKYPKLESEFVYGDYKVYDVRKMIAKSEQEIGKATAKYFFYSNIMNFFK

TEITLANGEIRKRPLIETNGETGEIVWDKGRDFATVRKVLSMPQVNIVKK

TEVQTGGFSKESILPKRNSDKLIARKKDWDPKKYGGFDSPTVAYSVLVVA

KVEKGKSKKLKSVKELLGITIMERSSFEKNPIDFLEAKGYKEVKKDLIIK

LPKYSLFELENGRKRMLASAGELQKGNELALPSKYVNFLYLASHYEKLKG

SPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATL

IHQSITGLYETRIDLSQLGGD

113 N-term single TadA helix trunc 165-end
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRSGGSSGGSSSGSETPGTSESATPESSGGSSGGSDKKYSIGLAIGTNSV

GWAVITDEYKVPSKKFKVLGNTDRHSIKKNLIGALLFDSGETAEATRLKR

TARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRG

HFLIEGDLNPDNSDVDKLFIQLVQTYNQLFEENPINASGVDAKAILSARL

SKSRRLENLIAQLPGEKKNGLFGNLIALSLGLTPNFKSNFDLAEDAKLQL

SKDTYDDDLDNLLAQIGDQYADLFLAAKNLSDAILLSDILRVNTEITKAP

LSASMIKRYDEHHQDLTLLKALVRQQLPEKYKEIFFDQSKNGYAGYIDGG

ASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMT

RKSEETITPWNFEEVVDKGASAQSFIERMTNFDKNLPNEKVLPKHSLLYE

YFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDIL

-continued

```
EDIVLTLTLFEDREMIEERLKTYAHLFDDKVMKQLKRRRYTGWGRLSRKL

INGIRDKQSGKTILDFLKSDGFANRNFMQL1HDDSLTFKEDIQKAQVSGQ

GDSLHEHIANLAGSPAIKKGILQTVKVVDELVKVMGRHKPENIVIEMARE

NQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGK

SDNVPSEEVVKKMKNYWRQLLNAKLITQRKFDNLTKAERGGLSELDKAGF

IKRQLVETRQITKHVAQILDSRMNTKYDENDKLIREVKVITLKSKLVSDF

RKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETN

GETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYL

DEIIEQISEFSKRVILADANLDKVLSAYNKHRDKPIREQAENIIHLFTLT

NLGAPAAFKYFDTTIDRKRYTSTKEVLDATLIHQSITGLYETRIDLSQLG

GD
```

114 N-term single TadA helix trunc 165-end
delta 59-65
```
MSEVEFSHEYWMRHALTLAKRARDEREVPVGAVLVLNNRVIGEGWNRTAH

AEIMALRQGGLVMQNYRLIDATLYVTFEPCVMCAGAMIHSRIGRVVFGVR

NAKTGAAGSLMDVLHYPGMNHRVEITEGILADECAALLCYFFRMPRSGGS

SGGSSGSETPGTSESATPESSGGSSGGSDKKYSIGLAIGTNSVGWAVITD

EYKVPSKKFKVLGNTDRHSIKKNLIGALLFDSGETAEATRLKRTARRRYT

RRKNRICYLQEIFSNEMAKVDDSFFHRLEESFLVEEDKKHERHPIFGNIV

DEVAYHEKYPTIYHLRKKLVDSTDKADLRLIYLALAHMIKFRGHFLIEGD

LNPDNSDVDKLFIQLVQTYNQLFEENPINASGVDAKAILSARLSKSRRLE

NLIAQLPGEKKNGLFGNLIALSLGLTPNFKSNFDLAEDAKLQLSKDTYDD

DLDNLLAQIGDQYADLFLAAKNLSDAILLSDILRVNTEITKAPLSASMIK

RYDEHHQDLTLLKALVRQQLPEKYKEIFFDQSKNGYAGYIDGGASQEEFY

KFIKPILEKMDGTEELLVKLNREDLLRKQRTFDNGSIPHQIHLGELHAIL

RRQEDFYPFLKDNREKIEKILTFRIPYYVGPLARGNSRFAWMTRKSEETI

TPWNFEEVVDKGASAQSFIERMTNFDKNLPNEKVLPKHSLLYEYFTVYNE

LTKVKYVTEGMRKPAFLSGEQKKAIVDLLFKTNRKVTVKQLKEDYFKKIE

CFDSVEISGVEDRFNASLGTYHDLLKIIKDKDFLDNEENEDILEDIVLTL

TLFEDREMIEERLKTYAHLFDDKVMKQLKRRRYTGWGRLSRKLINGIRDK

QSGKTILDFLKSDGFANRNFMQLIHDDSLTFKEDIQKAQVSGQGDSLHEH

IANLAGSPAIKKGILQTVKVVDELVKVMGRHKPENIVIEMARENQTTQKG

QKNSRERMKRIEEGIKELGSQILKEHPVENTQLQNEKLYLYYLQNGRDMY

VDQELDINRLSDYDVDHIVPQSFLKDDSIDNKVLTRSDKNRGKSDNVPSE

EVVKKMKNYWRQLLNAKLITQRKFDNLTKAERGGLSELDKAGFIKRQLVE

TRQITKHVAQILDSRMNTKYDENDKLIREVKVITLKSKLVSDFRKDFQFY
```

-continued

```
KVREINNYHHAHDAYLNAVVGTALIKKYPKLESEFVYGDYKVYDVRKMIA

KSEQEIGKATAKYFFYSNIMNFFKTEITLANGEIRKRPLIETNGETGEIV

WDKGRDFATVRKVLSMPQVNIVKKTEVQTGGFSKESILPKRNSDKLIARK

KDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKG

NELALPSKYVNFLYLASHYEKLKGSPEDNEQKQLFVEQHKHYLDEIIEQI

SEFSKRVILADANLDKVLSAYNKHRDKPIREQAENIIHLFTLTNLGAPAA

FKYFDTTIDRKRYTSTKEVLDATLIFIQSITGLYETRIDLSQLGGD
```

115.1 Cas9 TadAins 1004
```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKGSSGSETPGTSESATPESSGGSEVEFSHEYWMRHALTLAKRARDEREV

PVGAVLVLNNRVIGEGWNRAIGLHDPTAHAEIMALRQGGLVMQNYRLIDA

TLYVTFEPCVMCAGAMIHSRIGRVVFGVRNAKTGAAGSLMDVLHYPGMNH

RVEITEGILADECAALLCYFFRMPRQLESEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLI1KLPKYSLFELENGRKRMLASAGELQKGNELA

LPSKYVNFLYLASHYEKLKGSPEDNEQKQLFVEQHKHYLDEIIEQISEFS
```

-continued

KRVILADANLDKVLSAYNKHRDKPIREQAENEHLFTLTNLGAPAAFKYF

DTTIDRKRYTSTKEVLDATLIHQSITGLYETRIDLSQLGGD 115.2 Cas9 TadAins 1005
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHRQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLGSSGSETPGTSESATPESSGSEVEFSHEYWMRHALTLAKRARDERE

VPVGAVLVLNNRVIGEGWNRAIGLHDPTAHAEIMALRQGGLVMQNYRLID

ATLYVTFEPCVMCAGAMIHSRIGRVVFGVRNAKTGAAGSLMDVLHYPGMN

HRVEITEGILADECAALLCYFFRMPRQESEFVYGDYKVYDVRKMIAKSEQ

EIGKATAKYFFYSNIMNFFKTEITLANGE1RKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD 115.3 Cas9 TadAins 1006
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

-continued

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLEGSSGSETPGTSESATPESSGSEVEFSHEYWMRHALTLAKRARDER

EVPVGAVLVLNNRVIGEGWNRAIGLHDPTAHAEIMALRQGGLVMQNYRLI

DATLYVTFEPCVMCAGAMIHSRIGRVVFGVRNAKTGAAGSLMDVLHYPGM

NHRVEITEGILADECAALLCYFFRMPRQSEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD 115.4 Cas9 TadAins 1007
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFRR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESGSSGSETPGTSESATPESSGSEVEFSHEYWMRHALTLAKRARDE

REVPVGAVLVLNNRVIGEGWNRAIGLHDPTAHAEIMALRQGGLVMQNYRL

IDATLYVTFEPCVMCAGAMIHSRIGRVVFGVRNAKTGAAGSLMDVLHYPG

MNHRVEITEGILADECAALLCYFFRMPRQEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD 116.1 Cas9 TadAins C-term truncate2 792
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGGSSGSETP

GTSESATPESSGSEVEFSHEYWMRHALTLAKRARDEREVPVGAVLVLNNR

VIGEGWNRAIGLHDPTAHAEIMALRQGGLVMQNYRLIDATLYVTFEPCVM

CAGAMIHSRIGRVVFGVRNAKTGAAGSLMDVLHYPGMNHRVEITEGILAD

ECAALLCYFFRMPRQSQILKEHPVENTQLQNEKLYLYYLQNGRDMYVDQE

LDINRLSDYDVDHIVPQSFLKDDSIDNKVLTRSDKNRGKSDNVPSEEVVK

KMKNYWRQLLNAKLITQRKFDNLTKAERGGLSELDKAGFIKRQLVETRQI

TKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD 116.2 Cas9 TadAins C-term truncate2 791
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSSGSETPG

TSESATPESSGSEVEFSHEYWMRHALTLAKRARDEREVPVGAVLVLNNRV

IGEGWNRAIGLHDPTAHAEIMALRQGGLVMQNYRLIDATLYVTFEPCVMC

AGAMIHSRIGRVVFGVRNAKTGAAGSLMDVLHYPGMNHRVEITEGILADE

CAALLCYFFRMPRQGSQILKEHPVENTQLQNEKLYLYYLQNGRDMYVDQE

LDINRLSDYDVDHIVPQSFLKDDSIDNKVLTRSDKNRGKSDNVPSEEVVK

KMKNYWRQLLNAKLITQRKFDNLTKAERGGLSELDKAGFIKRQLVETRQI

TKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD 116.3 Cas9 TadAins C-term truncate2 790
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

-continued
```
LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKEGSSGSETPGT

SESATPESSGSEVEFSHEYWMRHALTLAKRARDEREVPVGAVLVLNNRVI

GEGWNRAIGLHDPTAHAEIMALRQGGLVMQNYRLIDATLYVTFEPCVMCA

GAMIHSRIGRVVFGVRNAKTGAAGSLMDVLHYPGMNHRVEITEGILADEC

AALLCYFFRMPRQLGSQILKEHPVENTQLQNEKLYLYYLQNGRDMYVDQE

LDINRLSDYDVDHIVPQSFLKDDSIDNKVLTRSDKNRGKSDNVPSEEVVK

KMKNYWRQLLNAKLITQRKFDNLTKAERGGLSELDKAGFIKRQLVETRQI

TKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD

117 Cas9 delta 1017-1069
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD
```

-continued
```
LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYSSGSEVEFSHEYWMRHALTLAKRARDEREVPVGA

VLVLNNRVIGEGWNRAIGLHDPTAHAEIMALRQGGLVMQNYRLIDATLYV

TFEPCVMCAGAMIHSRIGRVVFGVRNAKTGAAGSLMDVLHYPGMNHRVEI

TEGILADECAALLCYFFRMPRQVFNAQKKAQSSTDGEIVWDKGRDFATVR

KVLSMPQVNIVKKTEVQTGGFSKESILPKRNSDKLIARKKDWDPKKYGGF

DSPTVAYSVLVVAKVEKGKSKKLKSVKELLGITIMERSSFEKNPIDFLEA

KGYKEVKKDLIIKLPKYSLFELENGRKRMLASAGELQKGNELALPSKYVN

FLYLASHYEKLKGSPEDNEQKQLFVEQHKHYLDEIIEQISEFSKRVILAD

ANLDKVLSAYNKHRDKPIREQAENIIHLFTLTNLGAPAAFKYFDTTIDRK

RYTSTKEVLDATLIEQSITGLYETRIDLSQLGGD

118 Cas9 TadA-CP116ins 1067
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI
```

-continued

TLANGEIRKRPLIETNMNHRVEITEGILADECAALLCYFFRMPRQVFNAQ

KKAQSSTDGSSGSETPGTSESATPESSGSEVEFSHEYWMRHALTLAKRAR

DEREVPVGAVLVLNNRVIGEGWNRAIGLHDPTAHAEIMALRQGGLVMQNY

RLIDATLYVTFEPCVMCAGAMIHSRIGRVVFGVRNAKTGAAGSLMDVLHY

PGGETGEIVWDKGRDFATVRKVLSMPQVNIVKKIEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

119 Cas9 TadAins 701
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHRQDLTLLKALVRQQLPEKYKEI

FFDQSKNGYAGYIDGGASQEEFYKFIKPILEKMDGTEELLVKLNREDLLR

KQRTIDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SGSSGSETPGTSESATPESSGSEVEFSHEYWMRHALTLAKRARDEREVPV

GAVLVLNNRVIGEGWNRAIGLHDPTAHAEIMALRQGGLVMQNYRLIDATL

YVTFEPCVMCAGAMIHSRIGRVVFGVRNAKTGAAGSLMDVLHYPGMNHRV

EITEGILADECAALLCYFFRMPRQVFNAQKKAQSSTDLTFKEDIQKAQVS

GQGDSLHEHIANLAGSPAIKKGILQTVKVVDELVKVMGRHKPENIVIEMA

RENQTTQKGQKNSRERMKRIEEGIKELGSQILKEHPVENTQLQNEKLYLY

YLQNGRDMYVDQELDINRLSDYDVDHIVPQSFLKDDSIDNKVLTRSDKNR

GKSDNVPSEEVVKKMKNYWRQLLNAKLITQRKFDNLTKAERGGLSELDKA

GFIKRQLVETRQITKHVAQILDSRMNTKYDENDKLIREVKVITLKSKLVS

DERKDFQFYKVREINNYHHAHDAYLNAVVGTALIKKYPKLESEFVYGDYK

VYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

120 Cas9 TadACP136ins 1248
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKERGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNEDK

NLPNEKVLPKHSLLYEYFTVYNELTKVKYVTEGMRKPAFLSGEQKKAIVD

LLFKTNRKVTVKQLKEDYFKKIECEDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSMN

HRVEITEGILADECAALLCYFFRMPRQVFNAQKKAQSSTDGSSGSETPGT

SESATPESSGSEVEFSHEYWMRHALTLAKRARDEREVPVGAVLVLNNRVI

GEGWNRAIGLHDPTAHAEIMALRQGGLVMQNYRLIDATLYVTFEPCVMCA

GAMIHSRIGRVVFGVRNAKTGAAGSLMDVLHYPGPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

121 Cas9 TadACP136ins 1052
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

5

10

15

20

25

30

35

40

45

50

55

60

65

-continued

```
NFKSNFDLAEDAKLQLSKDTYDDDLDNLLAQIGDQYADLFLAAKNLSDAI

LLSDILRVNTEITKAPLSASM1KRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKG1LQTVKVVDELVKV

MGRHKPENIV1EMARENQTTQKGQKNSRERMKR1EEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLAMNHRVEITEGILADECAALLCYFFRMPRQVFNAQKKAQSSTDGSSGS

ETPGTSESATPESSGSEVEFSHEYWMRHALTLAKRARDEREVPVGAVLVL

NNRVIGEGWNRAIGLHDPTAHAEIMALRQGGLVMQNYRLIDATLYVTFEP

CVMCAGAMIHSRIGRVVFGVRNAKTGAAGSLMDVLHYPGNGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEI1EQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

122 Cas9 TadACP136ins 1041
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHM1KFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLEKTNRKVTVKQLKEDYFKKIECEDSVEISGVEDRFNASLGTYHDLLKI

IKDKDFLDNEENEDILEDIVLTLTLFEDREMIEERLKTYAHLFDDKVMKQ
```

-continued

```
LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSMNURVEITEG

ILADECAALLCYFFRMPRQVFNAQKKAQSSTDGSSGSETPGTSESATPES

SGSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIESRI

GRVVFGVRNAKTGAAGSLMDVLHYPGNIMNFEKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIELFT

LTNLGAPAAFKYFDTTIDRKRYTSTKEVLDATLIHQSITGLYETRIDLSQ

LGGD

123 Cas9 TadACP139ins 1299
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI
```

-continued

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRMN

HRVEITEGILADECAALLCYFFRMPRQVFNAQKKAQSSTDGSSGSETPGT

SESATPESSGSEVEFSHEYWMRHALTLAKRARDEREVPVGAVLVLNNRVI

GEGWNRAIGLHDPTAHAEIMALRQGGLVMQNYRLIDATLYVTFEPCVMCA

GAMIHSRIGRVVFGVRNAKTGAAGSLMDVLHYPGDKPIREQAENIIHLFT

LTNLGAPAAFKYFDTTIDRKRYTSTKEVLDATLIHQSITGLYETRIDLSQ

LGGD

124 Cas9 delta 792-872 TadAins
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSEVEFSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADECAALLCYFFRMPRQVFNAQ

KKAQSSTDEEVVKKMKNYWRQLLNAKLITQRKFDNLTKAERGGLSELDKA

GFIKRQLVETRQITKHVAQILDSRMNTKYDENDKLIREVKVITLKSKLVS

DFRKDFQFYKVREINNYHHAHDAYLNAVVGTALIKKYPKLESEFVYGDYK

VYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

-continued

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

125 Cas9 delta 792-906 TadAins
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSEVEFSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADECAALLCYFFRMPRQVFNAQ

KKAQSSTDGLSELDKAGFIKRQLVETRQITKHVAQILDSRMNTKYDENDK

LIREVKVITLKSKLVSDFRKDFQFYKVREINNYHHAHDAYLNAVVGTALI

KKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKT

EVQTGGFSKESILPKRNSDKLIARKKDWDPKKYGGFDSPTVAYSVLVVAK

VEKGKSKKLKSVKELLGITIMERSSFEKNPIDFLEAKGYKEVKKDLIIKL

PKYSLFELENGRKRMLASAGELQKGNELALPSKYVNFLYLASHYEKLKGS

PEDNEQKQLFVEQHKHYLDEIIEQISEFSKRVILADANLDKVLSAYNKHR

DKPIREQAENIIHLFTLINLGAPAAFKYFDTTIDRKRYTSTKEVLDATLI

HQSITGLYETRIDLSQLGGD

126 TadA CP65ins 1003
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

-continued

-continued

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

PRQVFNAQKKAQSSTDGSSGSETPGTSESATPESSGSEVEFSHEYWMRHA

LTLAKRARDEREVPVGAVLVLNNRVIGEGWNRAIGLHDPLESEFVYGDYK

VYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIBRKRYTSTKEVLDATLIHQSITGLYETRIDLSQ

LGGD

127 TadA CP65ins 1016
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVTAHAEIMALRQGGLVMQNYRLIDATLYVTFEPCVM

CAGAMIHSRIGRVVFGVRNAKTGAAGSLMDVLHYPGMNHRVEITEGILAD

ECAALLCYFFRMPRQVFNAQKKAQSSTDGSSGSETPGTSESATPESSGSE

VEFSHEYWMRHALTLAKRARDEREVPVGAVLVLNNRVIGEGWNRAIGLHD

PYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

128 TadA CP65ins 1022
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHRQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMINFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMITAHAEIMALRQGGLVMQNYRLIDATLYV

TFEPCVMCAGAMIHSRIGRVVFGVRNAKTGAAGSLMDVLHYPGMNHRVEI

TEGILADECAALLCYFFRMPRQVFNAQKKAQSSTDGSSGSETPGTSESAT

PESSGSEVEFSHEYWMRHALTLAKRARDEREVPVGAVLVLNNRVIGEGWN

-continued

-continued

RAIGLHDPAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

129 TadA CP65ins 1029
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEITAHAEIMALRQGGLVMQNYRL

IDATLYVTFEPCVMCAGAMIHSRIGRVVFGVRNAKTGAAGSLMDVLHYPG

MNHRVEITEGILADECAALLCYFFRMPRQVFNAQKKAQSSTDGSSGSETP

GTSESATPESSGSEVEFSHEYWMRHALTLAKRARDEREVPVGAVLVLNNR

VIGEGWNRAIGLHDPGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEYKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

130 TadA CP65ins 1041
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHRQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSTAHAEIMALR

QGGLVMQNYRLIDATLYVTFEPCVMCAGAMIHSRIGRVVFGVRNAKTGAA

GSLMDVLHYPGMNHRVEITEGILADECAALLCYFFRMPRQVFNAQKKAQS

STDGSSGSETPGTSESATPESSGSEVEFSHEYWMRHALTLAKRARDEREV

PVGAVLVLNNRVIGEGWNRAIGLHDPNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

131 TadA CP65ins 1054
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

-continued

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVETSGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTDGSSGSETPGTSESATPESSGSEVEFSHEYWMRH

ALTLAKRARDEREVPVGAVLVLNNRVIGEGWNRAIGLHDPGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

132 TadA CP65ins 1246
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

-continued

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGTAH

AEIMALRQGGLVMQNYRLIDATLYVTFEPCVMCAGAMIHSRIGRVVFGVR

NAKTGAAGSLMDVLHYPGMNHRVEITEGILADECAALLCYFFRMPRQVFN

AQKKAQSSTDGSSGSETPGTSESATPESSGSEVEFSHEYWMRHALTLAKR

ARDEREVPVGAVLVLNNRVIGEGWNRAIGLHDPSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

Protospacer Adjacent Motif

The term "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer).

The PAM sequence is essential for target binding, but the exact sequence depends on a type of Cas protein.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities. For example, typically Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length. Several PAM variants are described in Table 1.

In some embodiments, the SpCas9 has specificity for PAM nucleic acid sequence 5'-NGC-3' or 5'-NGG-3'. In various embodiments of the above aspects, the SpCas9 is a Cas9 or Cas9 variant listed in Table 1. In various embodiments of the above aspects, the modified SpCas9 is spCas9-MQKFRAER. In some embodiments, the variant Cas protein can be spCas9, spCas9-VRQR, spCas9-VRER, xCas9

(sp), saCas9, saCas9-KKH, SpCas9-MQKFRAER, spCas9-MQKSER, spCas9-LRKIQK, or spCas9-LRVSQL. In one specific embodiment, a modified SpCas9 including amino acid substitutions D1135M, S 1136Q, G1218K, E1219F, A1322R, D1332A, R1335E, and T1337R (SpCas9-MQKFRAER) and having specificity for the altered PAM 5'-NGC-3' is used.

In some embodiments, the PAM is NGT. In some embodiments, the NGT PAM is a variant. In some embodiments, the NGT PAM variant is created through targeted mutations at one or more residues 1335, 1337, 1135, 1136, 1218, and/or 1219. In some embodiments, the NGT PAM variant is created through targeted mutations at one or more residues 1219, 1335, 1337, 1218. In some embodiments, the NGT PAM variant is created through targeted mutations at one or more residues 1135, 1136, 1218, 1219, and 1335. In some embodiments, the NGT PAM variant is selected from the set of targeted mutations provided in Tables 2 and 3 below.

TABLE 2

| | NGT PAM Variant Mutations at residues 1219, 1335, 1337, 1218 | | | |
|---|---|---|---|---|
| Variant | E1219V | R1335Q | T1337 | G1218 |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |
| 21 | L | A | W | |
| 22 | L | A | F | |
| 23 | L | A | Y | |
| 24 | I | A | W | |
| 25 | I | A | F | |
| 26 | I | A | Y | |

TABLE 3

| | NGT PAM Variant Mutations at residues 1135, 1136, 1218, 1219, and 1335 | | | | |
|---|---|---|---|---|---|
| Variant | D1135L | S1136R | G1218S | E1219V | R1335Q |
| 27 | G | | | | |
| 28 | V | | | | |
| 29 | I | | | | |
| 30 | | | A | | |
| 31 | | | W | | |
| 32 | | | H | | |
| 33 | | | K | | |
| 34 | | | | K | |
| 35 | | | | R | |
| 36 | | | | Q | |

TABLE 3-continued

| | NGT PAM Variant Mutations at residues 1135, 1136, 1218, 1219, and 1335 | | | | |
|---|---|---|---|---|---|
| Variant | D1135L | S1136R | G1218S | E1219V | R1335Q |
| 37 | | | T | | |
| 38 | | | N | | |
| 39 | | | | I | |
| 40 | | | | A | |
| 41 | | | | N | |
| 42 | | | | Q | |
| 43 | | | | G | |
| 44 | | | | L | |
| 45 | | | | S | |
| 46 | | | | T | |
| 47 | | | | | L |
| 48 | | | | | I |
| 49 | | | | | V |
| 50 | | | | | N |
| 51 | | | | | S |
| 52 | | | | | T |
| 53 | | | | | F |
| 54 | | | | | Y |
| 55 | N1286Q | I1331F | | | |

In some embodiments, the NGT PAM variant is selected from variant 5, 7, 28, 31, or 36 in Tables 2 and 3. In some embodiments, the variants have improved NGT PAM recognition.

In some embodiments, the NGT PAM variants have mutations at residues 1219, 1335, 1337, and/or 1218. In some embodiments, the NGT PAM variant is selected with mutations for improved recognition from the variants provided in Table 4 below.

TABLE 4

| | NGT PAM Variant Mutations at residues 1219, 1335, 1337, and 1218 | | | |
|---|---|---|---|---|
| Variant | E1219V | R1335Q | T1337 | G1218 |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

In some embodiments, the NGT PAM is selected from the variants provided in Table 5 below.

TABLE 5

| | NGTN variant | D1135 | S1136 | G1218 | E1219 | A1322R | R1335 | T1337 |
|---|---|---|---|---|---|---|---|---|
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | S | V | R | Q | L |

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein may be fused with any of the cytidine deaminases or adenosine deaminases provided herein In some embodiments, the SpCas9 domain comprises one or more of a D1135X, a R1335X, and a T1336X mutation, or a corresponding mutation in any of the amino acid sequences provided herein, wherein X is any amino acid. In some embodiments, the SpCas9 domain comprises one or more of a D1135E, R1335Q, and T1336R mutation, or a corresponding mutation in any of the amino acid sequences provided herein. In some embodiments, the SpCas9 domain comprises a D1135E, a R1335Q, and a T1336R mutation, or corresponding mutations in any of the amino acid sequences provided herein. In some embodiments, the SpCas9 domain comprises one or more of a D1135X, a R1335X, and a T1336X mutation, or a corresponding mutation in any of the amino acid sequences provided herein, wherein X is any amino acid. In some embodiments, the SpCas9 domain comprises one or more of a D1135V, a R1335Q, and a T1336R mutation, or a corresponding mutation in any of the amino acid sequences provided herein. In some embodiments, the SpCas9 domain comprises a D1135V, a R1335Q, and a T1336R mutation, or corresponding mutations in any of the amino acid sequences provided herein. In some embodiments, the SpCas9 domain comprises one or more of a D1135X, a G1217X, a R1335X, and a T1336X mutation, or a corresponding mutation in any of the amino acid sequences provided herein, wherein X is any amino acid. In some embodiments, the SpCas9 domain comprises one or more of a D1135V, a G1217R, a R1335Q, and a T1336R mutation, or a corresponding mutation in any of the amino acid sequences provided herein. In some embodiments, the SpCas9 domain comprises a D1135V, a G1217R, a R1335Q, and a T1336R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

In some examples, a PAM recognized by a CRISPR protein-derived domain of a base editor disclosed herein can be provided to a cell on a separate oligonucleotide to an insert (e.g., an AAV insert) encoding the base editor. In such embodiments, providing PAM on a separate oligonucleotide can allow cleavage of a target sequence that otherwise would not be able to be cleaved, because no adjacent PAM is present on the same polynucleotide as the target sequence.

In an embodiment, *S. pyogenes* Cas9 (SpCas9) can be used as a CRISPR endonuclease for genome engineering. However, others can be used. In some embodiments, a different endonuclease can be used to target certain genomic targets. In some embodiments, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4 kilobase (kb) coding sequence) can lead to plasmids carrying the SpCas9 cDNA that cannot be efficiently expressed in a cell. Conversely, the coding sequence for *Staphylococcus aureus* Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some embodiments, a Cas protein can target a different PAM sequence. In some embodiments, a target gene can be adjacent to a Cas9 PAM, 5'-NGG, for example. In other embodiments, other Cas9 orthologs can have different PAM requirements. For example, other PAMs such as those of *S. thermophilus* (5'-NNAGAA for CRISPR1 and 5'-NGGNG for CRISPR3) and *Neisseria meningitidis* (5'-NNNNGATT) can also be found adjacent to a target gene.

In some embodiments, for a *S. pyogenes* system, a target gene sequence can precede (i.e., be 5' to) a 5'-NGG PAM, and a 20-nt guide RNA sequence can base pair with an opposite strand to mediate a Cas9 cleavage adjacent to a PAM. In some embodiments, an adjacent cut can be or can be about 3 base pairs upstream of a PAM. In some embodiments, an adjacent cut can be or can be about 10 base pairs upstream of a PAM. In some embodiments, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs. The sequences of exemplary SpCas9 proteins capable of binding a PAM sequence follow:

The amino acid sequence of an exemplary PAM-binding SpCas9 is as follows:

MDKKYSIGLDIGTNSVGWAVITDEYKVPSKKFKVL

GNTDRHSIKKNLIGALLFDSGETAEATRLKRTARR

RYTRRKNRICYLQEIFSNEMAKVDDSFFHRLEESF

LVEEDKKHERHPIFGNIVDEVAYHEKYPTIYHLRK

KLVDSTDKADLRLIYLALAHMIKFRGHFLIEGDLN

PDNSDVDKLFIQLVQTYNQLFEENPINASGVDAKA

ILSARLSKSRRLENLIAQLPGEKKNGLFGNLIALS

LGLTPNFKSNFDLAEDAKLQLSKDTYDDDLDNLLA

QIGDQYADLFLAAKNLSDAILLSDILRVNTEITKA

PLSASMIKRYDEHHQDLTLLKALVRQQLPEKY

KEIFFDQSKNGYAGYIDGGASQEEFYKFIKPILEK

MDGTEELLVKLNREDLLRKQRTFDNGSIPHQIHLG

ELHAILRRQEDFYPFLKDNREKIEKILTFRIPYYV

GPLARGNSRFAWMTRKSEETITPWNFEEVVDKGAS

AQSFIERMTNFDKNLPNEKVLPKHSLLYEYFTVYN

ELTKVKYVTEGMRKPAFLSGEQKKAIVDLLFKTNR

KVTVKQLKEDYFKKIECFDSVEISGVEDRFNASLG

TYHDLLKIIKDKDFLDNEENEDILEDIVLTLTLFE

DREMIEERLKTYAHLFDDKVMKQLKRRRYTGWGRL

SRKLINGIRDKQSGKTILDFLKSDGFANRNFMQLI

HDDSLTFKEDIQKAQVSGQGDSLHEHIANLAGSPA

IKKGILQTVKVVDELVKVMGRHKPENIVIEMAREN

QTTQKGQKNSRERMKRIEEGIKELGSQILKEHPVE

NTQLQNEKLYLYYLQNGRDMYVDQELDINRLSDYD

VDHIVPQSFLKDDSIDNKVLTRSDKNRGKSDNVPS

EEVVKKMKNYWRQLLNAKLITQRKFDNLTKAERGG

LSELDKAGFIKRQLVETRQITKHVAQILDSRMNTK

YDENDKLIREVKVITLKSKLVSDFRKDFQFYKVRE

INNYHHAHDAYLNAVVGTALIKKYPKLESEFVYGD

YKVYDVRKMIAKSEQEIGKATAKYFFYSNIMNFFK

TEITLANGEIRKRPLIETNGETGEIVWDKGRDFAT

VRKVLSMPQVNIVKKTEVQTGGFSKESILPKRNSD

KLIARKKDWDPKKYGGFDSPTVAYSVLVVAKVEKG

KSKKLKSVKELLGITIMERSSFEKNPIDFLEAKGY

KEVKKDLIIKLPKYSLFELENGRKRMLASAGELQK

GNELALPSKYVNFLYLASHYEKLKGSPEDNEQKQL

FVEQHKHYLDEIIEQISEFSKRVILADANLDKVLS

AYNKHRDKPIREQAENIIHLFTLTNLGAPAAFKYF

DTTIDRKRYTSTKEVLDATLIHQSITGLYETRIDL

SQLGGD.

The amino acid sequence of an exemplary PAM-binding SpCas9n is as follows:

MDKKYSIGLAIGTNSVGWAVITDEYKVPSKKFKVL

GNTDRHSIKKNLIGALLFDSGETAEATRLKRTARR

RYTRRKNRICYLQEIFSNEMAKVDDSFFHRLEESF

LVEEDKKHERHPIFGNIVDEVAYHEKYPTIYHLRK

KLVDSTDKADLRLIYLALAHMIKFRGHFLIEGDLN

PDNSDVDKLFIQLVQTYNQLFEENPINASGVDAKA

ILSARLSKSRRLENLIAQLPGEKKNGLFGNLIALS

LGLTPNFKSNFDLAEDAKLQLSKDTYDDDLDNLLA

QIGDQYADLFLAAKNLSDAILLSDILRVNTEITK

APLSASMIKRYDEHHQDLTLLKALVRQQLPEKY

KEIFFDQSKNGYAGYIDGGASQEEFYKFIKPILEK

MDGTEELLVKLNREDLLRKQRTFDNGSIPHQIHLG

ELHAILRRQEDFYPFLKDNREKIEKILTFRIPYYV

GPLARGNSRFAWMTRKSEETITPWNFEEVVDKGAS

AQSFIERMTNFDKNLPNEKVLPKHSLLYEYFTVYN

ELTKVKYVTEGMRKPAFLSGEQKKAIVDLLFKTNR

KVTVKQLKEDYFKKIECFDSVEISGVEDRFNASLG

TYHDLLKIIKDKDFLDNEENEDILEDIVLTLTLFE

DREMIEERLKTYAHLFDDKVMKQLKRRRYTGWGRL

SRKLINGIRDKQSGKTILDFLKSDGFANRNFMQLI

HDDSLTFKEDIQKAQVSGQGDSLHEHIANLAGSPA

IKKGILQTVKVVDELVKVMGRHKPENIVIEMAREN

QTTQKGQKNSRERMKRIEEGIKELGSQILKEHPVE

NTQLQNEKLYLYYLQNGRDMYVDQELDINRLSDYD

VDHIVPQSFLKDDSIDNKVLTRSDKNRGKSDNVPS

EEVVKKMKNYWRQLLNAKLITQRKFDNLTKAERGG

LSELDKAGFIKRQLVETRQITKHVAQILDSRMNTK

YDENDKLIREVKVITLKSKLVSDFRKDFQFYKVRE

INNYHHAHDAYLNAVVGTALIKKYPKLESEFVYGD

YKVYDVRKMIAKSEQEIGKATAKYFFYSNIMNFFK

TEITLANGEIRKRPLIETNGETGEIVWDKGRDFAT

VRKVLSMPQVNIVKKTEVQTGGFSKESILPKRNSD

KLIARKKDWDPKKYGGFDSPTVAYSVLVVAKVEKG

KSKKLKSVKELLGITIMERSSFEKNPIDFLEAKGY

KEVKKDLIIKLPKYSLFELENGRKRMLASAGELQK

GNELALPSKYVNFLYLASHYEKLKGSPEDNEQKQL

FVEQHKHYLDEIIEQISEFSKRVILADANLDKVLS

-continued

AYNKHRDKPIREQAENIIHLFTLTNLGAPAAFKYF

DTTIDRKRYTSTKEVLDATLIHQSITGLYETRIDL

SQLGGD.

The amino acid sequence of an exemplary
PAM-binding SpEQR Cas9 is as follows:
MDKKYSIGLAIGTNSVGWAVITDEYKVPSKKFKVL

GNTDRHSIKKNLIGALLFDSGETAEATRLKRTARR

RYTRRKNRICYLQEIFSNEMAKVDDSFFHRLEESF

LVEEDKKHERHPIFGNIVDEVAYHEKYPTIYHLRK

KLVDSTDKADLRLIYLALAHMIKFRGHFLIEGDLN

PDNSDVDKLFIQLVQTYNQLFEENPINASGVDAKA

ILSARLSKSRRLENLIAQLPGEKKNGLFGNLIALS

LGLTPNFKSNFDLAEDAKLQLSKDTYDDDLDNLLA

QIGDQYADLFLAAKNLSDAILLSDILRVNTEITK

APLSASMIKRYDEHHQDLTLLKALVRQQLPEKY

KEIFFDQSKNGYAGYIDGGASQEEFYKFIKPILEK

MDGTEELLVKLNREDLLRKQRTFDNGSIPHQIHLG

ELHAILRRQEDFYPFLKDNREKIEKILTFRIPYYV

GPLARGNSRFAWMTRKSEETITPWNFEEVVDKGAS

AQSFIERMTNFDKNLPNEKVLPKHSLLYEYFTVYN

ELTKVKYVTEGMRKPAFLSGEQKKAIVDLLFKTNR

KVTVKQLKEDYFKKIECFDSVEISGVEDRFNASLG

TYHDLLKIIKDKDFLDNEENEDILEDIVLTLTLFE

DREMIEERLKTYAHLFDDKVMKQLKRRRYTGWGRL

SRKLINGIRDKQSGKTILDFLKSDGFANRNFMQLI

HDDSLTFKEDIQKAQVSGQGDSLHEHIANLAGSPA

IKKGILQTVKVVDELVKVMGRHKPENIVIEMAREN

QTTQKGQKNSRERMKRIEEGIKELGSQILKEHPVE

NTQLQNEKLYLYYLQNGRDMYVDQELDINRLSDYD

VDHIVPQSFLKDDSIDNKVLTRSDKNRGKSDNVPS

EEVVKKMKNYWRQLLNAKLITQRKFDNLTKAERGG

LSELDKAGFIKRQLVETRQITKHVAQILDSRMNTK

YDENDKLIREVKVITLKSKLVSDFRKDFQFYKVRE

INNYHHAHDAYLNAVVGTALIKKYPKLESEFVYGD

YKVYDVRKMIAKSEQEIGKATAKYFFYSNIMNFFK

TEITLANGEIRKRPLIETNGETGEIVWDKGRDFAT

VRKVLSMPQVNIVKKTEVQTGGFSKESILPKRNSD

KLIARKKDWDPKKYGGFESPTVAYSVLVVAKVEKG

KSKKLKSVKELLGITIMERSSFEKNPIDFLEAKGY

KEVKKDLIIKLPKYSLFELENGRKRMLASAGELQK

GNELALPSKYVNFLYLASHYEKLKGSPEDNEQKQL

FVEQHKHYLDEIIEQISEFSKRVILADANLDKVLS

-continued

AYNKHRDKPIREQAENIIHLFTLTNLGAPAAFKYF

DTTIDRKQYRSTKEVLDATLIHQSITGLYETRIDL

SQLGGD.
In this sequence, residues E1135, Q1335
and R1337, which can be mutated from
D1135 , R1335, and T1337 to yield a
SpEQR Cas9, are underlined and in bold.

The amino acid sequence of an exemplary
PAM-binding SpVQR Cas9 is as follows:
MDKKYSIGLAIGTNSVGWAVITDEYKVPSKKFKVL

GNTDRHSIKKNLIGALLFDSGETAEATRLKRTARR

RYTRRKNRICYLQEIFSNEMAKVDDSFFHRLEESF

LVEEDKKHERHPIFGNIVDEVAYHEKYPTIYHLRK

KLVDSTDKADLRLIYLALAHMIKFRGHFLIEGDLN

PDNSDVDKLFIQLVQTYNQLFEENPINASGVDAKA

ILSARLSKSRRLENLIAQLPGEKKNGLFGNLIALS

LGLTPNFKSNFDLAEDAKLQLSKDTYDDDLDNLLA

QIGDQYADLFLAAKNLSDAILLSDILRVNTEITK

APLSASMIKRYDEHHQDLTLLKALVRQQLPEKY

KEIFFDQSKNGYAGYIDGGASQEEFYKFIKPILEK

MDGTEELLVKLNREDLLRKQRTFDNGSIPHQIHLG

ELHAILRRQEDFYPFLKDNREKIEKILTFRIPYYV

GPLARGNSRFAWMTRKSEETITPWNFEEVVDKGAS

AQSFIERMTNFDKNLPNEKVLPKHSLLYEYFTVYN

ELTKVKYVTEGMRKPAFLSGEQKKAIVDLLFKTNR

KVTVKQLKEDYFKKTECFDSVEISGVEDRFNASLG

TYHDLLKIIKDKDFLDNEENEDILEDIVLTLTLFE

DREMIEERLKTYAHLFDDKVMKQLKRRRYTGWGRL

SRKLINGIRDKQSGKTILDFLKSDGFANRNFMQLI

HDDSLTFKEDIQKAQVSGQGDSLHEHIANLAGSPA

IKKGILQTVKVVDELVKVMGRHKPENIVIEMAREN

QTTQKGQKNSRERMKRIEEGIKELGSQILKEHPVE

NTQLQNEKLYLYYLQNGRDMYVDQELDINRLSDYD

VDHIVPQSFLKDDSIDNKVLTRSDKNRGKSDNVPS

EEVVKKMKNYWRQLLNAKLITQRKFDNLTKAERGG

LSELDKAGFIKRQLVETRQITKHVAQILDSRMNTK

YDENDKLIREVKVITLKSKLVSDFRKDFQFYKVRE

INNYHHAHDAYLNAVVGTALIKKYPKLESEFVYGD

YKVYDVRKMIAKSEQEIGKATAKYFFYSNIMNFFK

TEITLANGEIRKRPLIETNGETGEIVWDKGRDFAT

VRKVLSMPQVNIVKKTEVQTGGFSKESILPKRNSD

KLIARKKDWDPKKYGGFVSPTVAYSVLVVAKVEKG

KSKKLKSVKELLGITIMERSSFEKNPIDFLEAKGY

-continued

KEVKKDLIIKLPKYSLFELENGRKRMLASAGELQK

GNELALPSKYVNFLYLASHYEKLKGSPEDNEQKQL

FVEQHKHYLDEIIEQISEFSKRVILADANLDKVLS

AYNKHRDKPIREQAENIIHLFTLTNLGAPAAFKYF

DTTIDRK<u>QYR</u>STKEVLDATLIHQSITGLYETRIDL

SQLGGD.

In this sequence, residues V1135, Q1335, and R1336, which can be mutated from D1135, R1335, and T1336 to yield a SpVQR Cas9, are underlined and in bold.

The amino acid sequence of an exemplary PAM-binding SpVRER Cas9 is as follows:
MDKKYSIGLAIGTNSVGWAVITDEYKVPSKKFKVL

GNTDRHSIKKNLIGALLFDSGETAEATRLKRTARR

RYTRRKNRICYLQEIFSNEMAKVDDSFFHRLEESF

LVEEDKKHERHPIFGNIVDEVAYHEKYPTIYHLRK

KLVDSTDKADLRLIYLALAHMIKFRGHFLIEGDLN

PDNSDVDKLFIQLVQTYNQLFEENPINASGVDAKA

ILSARLSKSRRLENLIAQLPGEKKNGLFGNLIALS

LGLTPNFKSNFDLAEDAKLQLSKDTYDDDLDNLLA

QIGDQYADLFLAAKNLSDAILLSDILRVNTEITKA

PLSASMIKRYDEHHQDLTLLKALVRQQLPEKY

KEIFFDQSKNGYAGYIDGGASQEEFYKFIKPILEK

MDGTEELLVKLNREDLLRKQRTFDNGSIPHQIHLG

ELHAILRRQEDFYPFLKDNREKIEKILTFRIPYYV

GPLARGNSRFAWMTRKSEETITPWNFEEVVDKGAS

AQSFIERMTNFDKNLPNEKVLPKHSLLYEYFTVYN

ELTKVKYVTEGMRKPAFLSGEQKKAIVDLLFKTNR

KVTVKQLKEDYFKKIECFDSVEISGVEDRFNASLG

TYHDLLKIIKDKDFLDNEENEDILEDIVLTLTLFE

DREMIEERLKTYAHLFDDKVMKQLKRRRYTGWGRL

SRKLINGIRDKQSGKTILDFLKSDGFANRNFMQLI

HDDSLTFKEDIQKAQVSGQGDSLHEHIANLAGSPA

IKKGILQTVKVVDELVKVMGRHKPENIVIEMAREN

QTTQKGQKNSRERMKRIEEGIKELGSQILKEHPVE

NTQLQNEKLYLYYLQNGRDMYVDQELDINRLSDYD

VDHIVPQSFLKDDSIDNKVLTRSDKNRGKSDNVPS

EEVVKKMKNYWRQLLNAKLITQRKFDNLTKAERGG

LSELDKAGFIKRQLVETRQITKHVAQILDSRMNTK

YDENDKLIREVKVITLKSKLVSDFRKDFQFYKVRE

INNYHHAHDAYLNAVVGTALIKKYPKLESEFVYGD

YKVYDVRKMIAKSEQEIGKATAKYFFYSNIMNFFK

TEITLANGEIRKRPLIETNGETGEIVWDKGRDFAT

VRKVLSMPQVNIVKKTEVQTGGFSKESILPKRNSD

-continued

KLIARKKDWDPKKYGGF<u>V</u>SPTVAYSVLVVAKVEKG

KSKKLKSVKELLGITIMERSSFEKNPIDFLEAKGY

KEVKKDLIIKLPKYSLFELENGRKRMLASA<u>REL</u>QK

GNELALPSKYVNFLYLASHYEKLKGSPEDNEQKQL

FVEQHKHYLDEIIEQISEFSKRVILADANLDKVLS

AYNKHRDKPIREQAENIIHLFTLTNLGAPAAFKYF

DTTIDRK<u>EYR</u>STKEVLDATLIHQSITGLYETRIDL

SQLGGD.

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a Spy-MacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMac-Cas9 domain, the SpCas9d domain, or the SpCas9n domain can bind to a nucleic acid sequence having a NAA PAM sequence.

Exemplary SpyMacCas9
MDKKYSIGLDIGTNSVGWAVITDDYKVPSKKFKVLGNTDRHSIKKNLIG

ALLFGSGETAEATRLKRTARRRYTRRKNRICYLQEIFSNEMAKVDDSFF

HRLEESFLVEEDKKHERHPIFGNIVDEVAYHEKYPTIYHLRKKLADSTD

KADLRLIYLALAHMIKFRGHFLIEGDLNPDNSDVDKLFIQLVQIYNQLF

EENPINASRVDAKAILSARLSKSRRLENLIAQLPGEKRNGLFGNLIALS

LGLTPNFKSNFDLAEDAKLQLSKDTYDDDLDNLLAQIGDQYADLFLAAK

NLSDAILLSDILRVNSEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGAYHDLLKIIKDKDFLDNEENEDILEDIVLTLTLFEDRGMIEERLK

TYAHLFDDKVMKQLKRRRYTGWGRLSRKLINGIRDKQSGKTILDFLKSD

GFANRNFMQLIHDDSLTFKEDIQKAQVSGQGHSLHEQIANLAGSPAIKK

GILQTVKIVDELVKVMGHKPENIVIEMARENQTTQKGQKNSRERMKRIE

EGIKELGSQILKEHPVENTQLQNEKLYLYYLQNGRDMYVDQELDINRLS

DYDVDHIVPQSFIKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEIQTVGQNGGLFDDNPKSPLEVTPSKLVPL

```
-continued
KKELNPKKYGGYQKPTTAYPVLLITDTKQLIPISVMNKKQFEQNPVKFL

RDRGYQQVGKNDFIKLPKYTLVDIGDGIKRLWASSKEIHKGNQLVVSKK

SQILLYHAHHLDSDLSNDYLQNHNQQFDVLFNEIISFSKKCKLGKEHIQ

KIENVYSNKKNSASIEELAESFIKLLGFTQLGATSPFNFLGVKLNQKQY

KGKKDYILPCTEGTLIRQSITGLYETRVDLSKIGED.
```

In some cases, a variant Cas9 protein harbors, H840A, P475A, W476A, N477A, D1125A, W1126A, and D1218A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1218A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1125A, W1126A, and D1218A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of Staphylococcus aureus CRISPR-Cas9 by modifying PAM recognition" Nature Biotechnology 33, 1293-1298 (2015); the entire contents of each are hereby incorporated by reference.

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain.

Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference.

```
High Fidelity Cas9 domain mutations relative
to Cas9 are shown in bold and underlines
DKKYSIGLAIGTNSVGWAVITDEYKVPSKKFKVLGN

TDRHSIKKNLIGALLFDSGETAEATRLKRTARRRY

TRRKNRICYLQEIFSNEMAKVDDSFFHRLEESFLV

EEDKKHERHPIFGNIVDEVAYHEKYPTIYHLRKKL

VDSTDKADLRLIYLALAHMIKFRGHFLIEGDLNPD

NSDVDKLFIQLVQTYNQLFEENPINASGVDAKAIL

SARLSKSRRLENLIAQLPGEKKNGLFGNLIALSLG

LTPNFKSNFDLAEDAKLQLSKDTYDDDLDNLLAQI

GDQYADLFLAAKNLSDAILLSDILRVNTEITKAPL

SASMIKRYDEHHQDLTLLKALVRQQLPEKYKEIFF

DQSKNGYAGYIDGGASQEEFYKFIKPILEKMDGTE

ELLVKLNREDLLRKQRTFDNGSIPHQIHLGELHAI

LRRQEDFYPFLKDNREKIEKILTFRIPYYVGPLAR

GNSRFAWMTRKSEETITPWNFEEVVDKGASAQSFI

ERMTAFDKNLPNEKVLPKHSLLYEYFTVYNELTKV

KYVTEGMRKPAFLSGEQKKAIVDLLFKTNRKVTVK

QLKEDYFKKIECFDSVEISGVEDRFNASLGTYHDL

LKIIKDKDFLDNEENEDILEDIVLTLTLFEDREMI

EERLKTYAHLFDDKVMKQLKRRRYTGWGALSRKLI

NGIRDKQSGKTILDFLKSDGFANRNFMALIHDDSL
```

-continued

```
TFKEDIQKAQVSGQGDSLEIEHIANLAGSPAIKKG

ILQTVKVVDELVKVMGRHKPENIVIEMARENQTTQ

KGQKNSRERMKRIEEGIKELGSQILKEHPVENTQL

QNEKLYLYYLQNGRDMYVDQELDINRLSDYDVDHI

VPQSFLKDDSIDNKVLTRSDKNRGKSDNVPSEEVV

KKMKNYWRQLLNAKLITQRKFDNLTKAERGGLSEL

DKAGFIKRQLVETRAITKHVAQILDSRMNTKYDEN

DKLIREVKVITLKSKLVSDFRKDFQFYKVREINNY

HHAHDAYLNAVVGTALIKKYPKLESEFVYGDYKVY

DVRKMIAKSEQEIGKATAKYFFYSNIMNFFKTEI

TLANGEMKRPLIETNGETGEIVWDKGRDFATVRKV

LSMPQVNIVKKTEVQTGGFSKESILPKRNSDKLIA

RKKDWDPKKYGGFDSPTVAYSVLVVAKVEKGKSKK

LKSVKELLGITIMERSSFEKNPIDFLEAKGYKEVK

KDLIIKLPKYSLFELENGRKRMLASAGELQKGNEL

ALPSKYVNFLYLASHYEKLKGSPEDNEQKQLFVEQ

HKHYLDEIIEQISEFSKRVILADANLDKVLSAYNK

EIRDKPIREQAENIIHLFTLTNLGAPAAFKYFDTT

IDRKRYTSTKEVLDATLIHQSITGLYETRIDLSQL

GGD
```

Nucleic Acid Programmable DNA Binding Proteins

Some aspects of the disclosure provide fusion proteins comprising domains that act as nucleic acid programmable DNA binding proteins, which may be used to guide a protein, such as a base editor, to a specific nucleic acid (e.g., DNA or RNA) sequence. In particular embodiments, a fusion protein comprises a nucleic acid programmable DNA binding protein domain and a deaminase domain. DNA binding proteins include, without limitation, Cas9 (e.g., dCas9 and nCas9), CasX, CasY, Cpf1, Cas12b/C2c1, and Cas12c/C2c3. One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., *Cell,* 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 inactivate Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a Cpf1 sequence disclosed herein, and comprises mutations corresponding to D917A, E1006A, D1255A, D917A/E1006A, D917A/D1255A, E1006A/D1255A, or D917A/E1006A/D1255A. It should be appreciated that Cpf1 from other bacterial species may also be used in accordance with the present disclosure.

```
Wild type Francisella novicida Cpf1
(D917, E1006, and D1255 are bolded
and underlined)
MSIYQEFVNKYSLSKTLRFELIPQGKTLENIKARG

LILDDEKRAKDYKKAKQIIDKYHQFFIEEILSSVC

ISEDLLQNYSDVYFKLKKSDDDNLQKDFKSAKDTI

KKQISEYIKDSEKFKNLFNQNLIDAKKGQESDLIL

WLKQSKDNGIELFKANSDITDIDEALEIIKSFKGW

TTYFKGFEIENRKNVYSSNDIPTSITYRIVDDNLP

KFLENKAKYESLKDKAPEAINYEQIKKDLAEELTF

DIDYKTSEVNQRVFSLDEVFEIANFNNYLNQSGIT

KFNTIIGGKFVNGENTKRKGINEYINLYSQQINDK

TLKKYKMSVLFKQILSDTESKSFVIDKLEDDSDVV

TTMQSFYEQIAAFKTVEEKSIKETLSLLFDDLKAQ

KLDLSKIYFKNDKSLTDLSQQVFDDYSVIGTAVLE

YITQQIAPKNLDNPSKKEQELIAKKTEKAKYLSLE

TIKLALEEFNKFIRDIDKQCRFEEILANFAAIPMI

FDEIAQNKDNLAQISIKYQNQGKKDLLQASAEDDV
```

-continued

```
KAIKDLLDQTNNLLHKLKIFHISQSEDKANILDKD

EHFYLVFEECYFELANIVPLYNKIRNYITQKPYSD

EKFKLNFENSTLANGWDKNKEPDNTAILFIKDDKY

YLGVMNKKNNKIFDDKAIKENKGEGYKKIVYKLLP

GANKMLPKVFFSAKSIKFYNPSEDILRIRNHSTHT

KNGSPQKGYEKFEFNIEDCRKFIDFYKQSISKHPE

WKDFGFRFSDTQRYNSIDEFYREVENQGYKLTFEN

ISESYIDSVVNQGKLYLFQIYNKDFSAYSKGRPNL

HTLYWKALFDERNLQDVVYKLNGEAELFYRKQSIP

KKITHPAKEAIANKNKDNPKKESVFEYDLIKDKRF

TEDKFFFHCPITINFKSSGANKFNDEINLLLKEKA

NDVHILSI<strong><u>D</u></strong>RGERHLAYYTLVDGKGNIIKQDTFNI

IGNDRMKTNYHDKLAAIEKDRDSARKDWKKINNIK

EMKEGYLSQVVHEIAKLVIEYNAIVVF<strong><u>E</u></strong>DLNFGFK

RGRFKVEKQVYQKLEKMLIEKLNYLVFKDNEFDKT

GGVLRAYQLTAPFETFKKMGKQTGIIYYVPAGFTS

KICPVTGFVNQLYPKYESVSKSQEFFSKFDKICYN

LDKGYFEFSFDYKNFGDKAAKGKWTIASFGSRLIN

FRNSDKNHNWDTREVYPTKELEKLLKDYSIEYGHG

ECIKAAICGESDKKFFAKLTSVLNTILQMRNSKTG

TELDYLISPVADVNGNFFDSRQAPKNMPQDA<strong><u>D</u></strong>ANG

AYHIGLKGLMLLGRIKNNQEGKKLNLVIKNEEYFE

FVQNRNN
```

*Francisella novicida* Cpf1
D917A (A917, E1006, and D1255
are bolded and underlined)

```
MSIYQEFVNKYSLSKTLRFELIPQGKTLENIK

ARGLILDDEKRAKDYKKAKQIIDKYH

QFFWEILSSVCISEDLLQNYSDVYFKLKKSDDDNL

QKDFKSAKDTIKKQISEYIKDSEKFKNLFNQNLID

AKKGQESDLILWLKQSKDNGIELFKANSDITDIDE

ALEIIKSFKGWTTYFKGFEIENRKNVYSSNDIPTS

IIYRIVDDNLPKFLENKAKYESLKDKAPEAINYEQ

IKKDLAEELTFDIDYKTSEVNQRVFSLDEVFEIAN

FNNYLNQSGITKFNTIIGGKFVNGENTKRKGINEY

INLYSQQINDKTLKKYKMSVLFKQILSDTESKSFV

IDKLEDDSDVVTTMQSFYEQIAAFKTVEEKSIKET

LSLLFDDLKAQKLDLSKIYFKNDKSLTDLSQQVFD

DYSVIGTAVLEYITQQIAPKNLDNPSKKEQELIAK

KTEKAKYLSLETIKLALEEFNKHRDIDKQCRFEEI

LANFAAIPMIFDEIAQNKDNLAQISIKYQNQGKKD

LLQASAEDDVKAIKDLLDQTNNLLHKLKIFHISQS
```

-continued

```
EDKANILDKDEHFYLVFEECYFELANIVPLYNKIR

NYITQKPYSDEKFKLNFENSTLANGWDKNKEPDNT

AILFIKDDKYYLGVMNKKNNKIFDDKAIKENKGEG

YKKIVYKLLPGANKMLPKVFFSAKSIKFYNPSEDI

LRIRNHSTHTKNGSPQKGYEKFEFNIEDCRKFIDF

YKQSISKHPEWKDFGFRFSDTQRYNSIDEFYREVE

NQGYKLTFENISESYIDSVVNQGKLYLFQIYNKDF

SAYSKGRPNLHTLYWKALFDERNLQDVVYKLNGEA

ELFYRKQSIPKKITHPAKEAIANKNKDNPKKESVF

EYDLIKDKRFTEDKFFFHCPITINFKSSGANKFND

EINLLLKEKANDVHILSI<strong><u>A</u></strong>RGERHLAYYTLVDGKG

NIIKQDTFNIIGNDRMKTNYHDKLAAIEKDRDSAR

KDWKKINNIKEMKEGYLSQVVHEIAKLVIEYNAIV

VF<strong><u>E</u></strong>DLNFGFKRGRFKVEKQVYQKLEKMLIEKLNYL

VFKDNEFDKTGGVLRAYQLTAPFETFKKMGKQTGI

IYYVPAGFTSKICPVTGFVNQLYPKYESVSKSQEF

FSKFDKICYNLDKGYFEFSFDYKNFGDKAAKGKWT

IASFGSRLINFRNSDKNHNWDTREVYPTKELEKLL

KDYSIEYGHGECIKAAICGESDKKFFAKLTSVLNT

ILQMRNSKTGTELDYLISPVADVNGNFFDSRQAPK

NMPQDA<strong><u>D</u></strong>ANGAYHIGLKGLMLLGRIKNNQEGKKLN

LVIKNEEYFEFVQNRNN
```

*Francisella novicida*
Cpf1 E1006A (D917, A1006, and D1255
are bolded and underlined)

```
MSIYQEFVNKYSLSKTLRFELIPQGKTLENIKARG

LILDDEKRAKDYKKAKQIIDKYHQFFIEEILSSVC

ISEDLLQNYSDVYFKLKKSDDDNLQKDFKSAKDTI

KKQISEYIKDSEKFKNLFNQNLIDAKKGQESDLIL

WLKQSKDNGIELFKANSDITDIDEALEIIKSFKGW

TTYFKGFHENRKNVYSSNDIPTSITYRIVDDNLPK

FLENKAKYESLKDKAPEAINYEQIKKDLAEELTFD

IDYKTSEVNQRVFSLDEVFEIANENNYLNQSGITK

ENTIIGGKFVNGENTKRKGINEYINLYSQQINDKT

LKKYKMSVLFKQILSDTESKSFVIDKLEDDSDVVT

TMQSFYEQIAAFKTVEEKSIKETLSLLFDDLKAQK

LDLSKIYFKNDKSLTDLSQQVFDDYSVIGTAVLEY

ITQQIAPKNLDNPSKKEQELIAKKTEKAKYLSLET

IKLALEEFNKHRDIDKQCRFEEILANFAAIPMIFD

EIAQNKDNLAQISIKYQNQGKKDLLQASAEDDVKA

IKDLLDQTNNLLHKLKIFHISQSEDKANILDKDEH

FYLVFEECYFELANIVPLYNKIRNYITQKPYSDEK
```

-continued

FKLNFENSTLANGWDKNKEPDNTAILFIKDDKYYL

GVMNKKNNKIFDDKAIKENKGEGYKKIVYKLLPGA

NKMLPKVFFSAKSIKEYNPSEDILRIRNHSTHTKN

GSPQKGYEKFEFNIEDCRKFIDFYKQSISKHPEWK

DFGFRFSDTQRYNSIDEFYREVENQGYKLTFENIS

ESYIDSVVNQGKLYLFQIYNKDFSAYSKGRPNLHT

LYWKALFDERNLQDVVYKLNGEAELFYRKQSIPKK

ITHPAKEAIANKNKDNPKKESVFEYDLIKDKRFTE

DKFFFHCPITINFKSSGANKFNDEINLLLKEKAND

VHILSIDRGERHLAYYTLVDGKGNIIKQDTENIIG

NDRMKTNYHDKLAALEKDRDSARKDWKKINNIKEM

KEGYLSQVVHEIAKLVIEYNAIVVFADLNEGFKRG

REKVEKQVYQKLEKMLIEKLNYLVEKDNEFDKTGG

VLRAYQLTAPFETFKKMGKQTGIIYYVPAGFTSKI

CPVTGFVNQLYPKYESVSKSQEFFSKFDKICYNLD

KGYFEFSFDYKNFGDKAAKGKWTIASFGSRLINFR

NSDKNHNWDTREVYPTKELEKLLKDYSIEYGHGEC

IKAAICGESDKKFFAKLTSVLNTILQMRNSKTGTE

LDYLISPVADVNGNFFDSRQAPKNMPQDADANGAY

HIGLKGLMLLGRIKNNQEGKKLNLVIKNEEYFEFV

QNRNN

*Francisella novicida* Cpf1 D1255A
(D917, E1006, and A1255 are bolded
and underlined)
MSIYQEFVNKYSLSKTLRFELIPQGKTLENIKARG

LILDDEKRAKDYKKAKQIIDKYHQFFIEEILSSVC

ISEDLLQNYSDVYFKLKKSDDDNLQKDFKSAKDTI

KKQISEYIKDSEKFKNLFNQNLIDAKKGQESDLIL

WLKQSKDNGIELFKANSDITDIDEALEIIKSFKGW

TTYFKGFHENRKNVYSSNDIPTSITYRIVDDNLPK

FLENKAKYESLKDKAPEAINYEQIKKDLAEELTFD

IDYKTSEVNQRVFSLDEVFEIANFNNYLNQSGITK

FNTIIGGKFVNGENTKRKGINEYINLYSQQINDKT

LKKYKMSVLFKQRSDTESKSFVIDKLEDDSDVVTT

MQSFYEQIAAFKTVEEKSIKETLSLLFDDLKAQKL

DLSKIYFKNDKSLTDLSQQVFDDYSVIGTAVLEYI

TQQIAPKNLDNPSKKEQELIAKKTEKAKYLSLETI

KLALEEFNKHRDIDKQCRFEEILANFAAIPMIFDE

IAQNKDNLAQISIKYQNQGKKDLLQASAEDDVKAI

KDLLDQTNNLLHKLKIFHISQSEDKANILDKDEHF

YLVFEECYFELANIVPLYNKIRNYITQKPYSDEKF

KLNFENSTLANGWDKNKEPDNTAILFIKDDKYYLG

-continued

VMNKKNNKIFDDKAIKENKGEGYKKIVYKLLPGAN

KMLPKVFFSAKSIKFYNPSEDILRIRNHSTHTKNG

SPQKGYEKFEFNIEDCRKFIDFYKQSISKHPEWKD

FGFRFSDTQRYNSIDEFYREVENQGYKLTFENISE

SYIDSVVNQGKLYLFQIYNKDFSAYSKGRPNLHTL

YWKALFDERNLQDVVYKLNGEAELFYRKQSIPKKI

THPAKEAIANKNKDNPKKESVFEYDLIKDKRFTED

KFFFHCPITINFKSSGANKFNDEINLLLKEKANDV

HILSIDRGERHLAYYTLVDGKGNIIKQDTFNIIGN

DRMKTNYHDKLAAIEKDRDSARKDWKKINNIKEMK

EGYLSQVVHEIAKLVIEYNAIVVFEDLNFGFKRGR

FKVEKQVYQKLEKMLIEKLNYLVFKDNEFDKTGGV

LRAYQLTAPFETFKKMGKQTGIIYYVPAGFTSKIC

PVTGFVNQLYPKYESVSKSQEFFSKFDKICYNLDK

GYFEFSFDYKNFGDKAAKGKWTIASFGSRLINFRN

SDKNHNWDTREVYPTKELEKLLKDYSIEYGHGECI

KAAICGESDKKFFAKLTSVLNTILQMRNSKTGTEL

DYLISPVADVNGNFFDSRQAPKNMPQDAAANGAYH

IGLKGLMLLGRIKNNQEGKKLNLVIKNEEYFEFVQ

NRNN

*Francisella novicida* Cpf1 D917A/
E1006A (A917, A1006, and D1255 are
bolded and underlined)
MSIYQEFVNKYSLSKTLRFELIPQGKTLENIKARG

LILDDEKRAKDYKKAKQIIDKYHQFFIEEILSSVC

ISEDLLQNYSDVYFKLKKSDDDNLQKDFKSAKDTI

KKQISEYIKDSEKFKNLFNQNLIDAKKGQESDLIL

WLKQSKDNGIELFKANSDITDIDEALEIIKSFKGW

TTYFKGFHENRKNVYSSNDIPTSITYRIVDDNLPK

FLENKAKYESLKDKAPEAINYEQIKKDLAEELTFD

IDYKTSEVNQRVFSLDEVFEIANFNNYLNQSGITK

FNTIIGGKFVNGENTKRKGINEYINLYSQQINDKT

LKKYKMSVLFKQILSDTESKSFVIDKLEDDSDVVT

TMQSFYEQIAAFKTVEEKSIKETLSLLFDDLKAQK

LDLSKIYFKNDKSLTDLSQQVFDDYSVIGTAVLEY

ITQQIAPKNLDNPSKKEQELIAKKTEKAKYLSLET

IKLALEEFNKHRDIDKQCRFEEILANFAAIPMIFD

EIAQNKDNLAQISIKYQNQGKKDLLQASAEDDVKA

IKDLLDQTNNLLHKLKIFHISQSEDKANILDKDEH

FYLVFEECYFELANIVPLYNKIRNYITQKPYSDEK

FKLNFENSTLANGWDKNKEPDNTAILFIKDDKYYL

GVMNKKNNKIFDDKAIKENKGEGYKKIVYKLLPGA

-continued

-continued

NKMLPKVFFSAKSIKFYNPSEDILRIRNHSTHTKN

GSPQKGYEKFEFNIEDCRKFIDFYKQSISKHPEWK

DFGFRFSDTQRYNSIDEFYREVENQGYKLTFENIS

ESYIDSVVNQGKLYLFQIYNKDFSAYSKGRPNLHT

LYWKALFDERNLQDVVYKLNGEAELFYRKQSIPKK

ITHPAKEAIANKNKDNPKKESVFEYDUKDKRFTED

KFFFHCPITINFKSSGANKFNDEINLLLKEKANDV

HILSIARGERHLAYYTLVDGKGNIIKQDTFNIIGN

DRMKTNYHDKLAAIEKDRDSARKDWKKINNIKEMK

EGYLSQVVHEIAKLVIEYNAIVVFADLNFGFKRGR

FKVEKQVYQKLEKMLIEKLNYLVFKDNEFDKTGGV

LRAYQLTAPFETFKKMGKQTGIIYYVPAGFTSKIC

PVTGFVNQLYPKYESVSKSQEFFSKFDKICYNLDK

GYFEFSFDYKNFGDKAAKGKWTIASFGSRLINFRN

SDKNHNWDTREVYPTKELEKLLKDYSIEYGHGECI

KAAICGESDKKFFAKLTSVLNTILQMRNSKTGTEL

DYLISPVADVNGNFFDSRQAPKNMPQDADANGAYH

IGLKGLMLLGRIKNNQEGKKLNLVIKNEEYFEFVQ

NRNN

*Francisella novicida* Cpf1 D917A/D1255A
(A917, E1006, and A1255 are bolded and
underlined)
MSIYQEFVNKYSLSKTLRFELIPQGKTLENIKARG

LILDDEKRAKDYKKAKQIIDKYHQFFIEEILSSVC

ISEDLLQNYSDVYFKLKKSDDDNLQKDFKSAKDTI

KKQISEYIKDSEKFKNLFNQNLIDAKKGQESDLIL

WLKQSKDNGIELFKANSDITDIDEALEIEKSFKGW

TTYFKGFHENRKNVYSSNDIPTSITYRIVDDNLPK

FLENKAKYESLKDKAPEAINYEQIKKDLAEELTFD

IDYKTSEVNQRVFSLDEVFEIANFNNYLNQSGITK

FNTIIGGKFVNGENTKRKGINEYINLYSQQINDKT

LKKYKMSVLFKQILSDTESKSFVIDKLEDDSDVVTT

MQSFYEQIAAFK

TVEEKSIKETLSLLFDDLKAQKLDLSKIYFKNDKS

LTDLSQQVFDDYSVIGTAVLEYITQQIAPKNLDNP

SKKEQELIAKKTEKAKYLSLETIKLALEEFNKFIR

DIDKQCRFEEILANFAAIPMIFDEIAQNKDNLAQIS

IKYQNQGKKDLLQASAEDDVKAIKDLLDQTNNLLHK

LKIFHISQSEDKANILDKDEHFYLVFEECYFELAN

IVPLYNKIRNYITQKPYSDEKFKLNFENSTLANGW

DKNKEPDNTAILFIKDDKYYLGVMNKKNNKIFDDK

AIKENKGEGYKKIVYKLLPGANKMLPKVFFSAKSI

KFYNPSEDILRIRNHSTHTKNGSPQKGYEKFEFNI

EDCRKFIDFYKQSISKHPEWKDFGFRFSDTQRYNS

IDEFYREVENQGYKLTFENISESYIDSVVNQGKLY

LFQIYNKDFSAYSKGRPNLHTLYWKALFDERNLQD

VVYKLNGEAELFYRKQSIPKKITHPAKEAIANKNK

DNPKKESVFEYDLIKDKRFTEDKFFFHCPITINFK

SSGANKFNDEINLLLKEKANDVHILSIARGERHLA

YYTLVDGKGNIIKQDTFNIIGNDRMKTNYHDKLAA

IEKDRDSARKDWKKINNIKEMKEGYLSQVVHEIAK

LVIEYNAIVVEDLNFGFKRGRFKVEKQVYQKLEK

MLIEKLNYLVFKDNEFDKTGGVLRAYQLTAPFETF

KKMGKQTGIIYYVPAGFTSKICPVTGFVNQLYPKY

ESVSKSQEFFSKFDKICYNLDKGYFEFSFDYKNFG

DKAAKGKWTIASFGSRLINFRNSDKNHNWDTREVY

PTKELEKLLKDYSIEYGHGECIKAAICGESDKKFF

AKLTSVLNTILQMRNSKTGTELDYLISPVADVNGN

FFDSRQAPKNMPQDAAANGAYHIGLKGLMLLGRIK

NNQEGKKLNLVIKNEEYFEFVQNRNN

*Francisella novicida* Cpf1 E1006A/D1255A
(D917, A1006, and A1255 are bolded and
underlined)
MSIYQEFVNKYSLSKTLRFELIPQGKTLENIKARG

LILDDEKRAKDYKKAKQIIDKYHQFFIEEILSSVC

ISEDLLQNYSDVYFKLKKSDDDNLQKDFKSAKDTI

KKQISEYIKDSEKFKNLFNQNLIDAKKGQESDLIL

WLKQSKDNGIELFKANSDITDIDEALEIIKSFKGW

TTYFKGFEIENRKNVYSSNDIPTSITYRIVDDNLP

KFLENKAKYESLKDKAPEAINYEQIKKDLAEELTF

DIDYKTSEVNQRVFSLDEVFEIANFNNYLNQSGIT

KFNTIIGGKFVNGENTKRKGINEYINLYSQQINDK

TLKKYKMSVLFKQILSDTESKSFVIDKLEDDSDVV

TTMQSFYEQIAAFKTVEEKSIKETLSLLFDDLKAQ

KLDLSKIYFKNDKSLTDLSQQVFDDYSVIGTAVLE

YITQQIAPKNLDNPSKKEQELIAKKTEKAKYLSLE

TIKLALEEFNKHRDIDKQCRFEEILANFAAIPMIF

DEIAQNKDNLAQISIKYQNQGKKDLLQASAEDDVK

AIKDLLDQTNNLLHKLKIFHISQSEDKANILDKDE

HFYLVFEECYFELANIVPLYNKIRNYITQKPYSDE

KFKLNFENSTLANGWDKNKEPDNTAILFIKDDKYY

LGVMNKKNNKIFDDKAIKENKGEGYKKIVYKLLPG

ANKMLPKVFFSAKSIKFYNPSEDILRIRNHSTHTK

NGSPQKGYEKFEFNIEDCRKFIDFYKQSISKHPEW

5

10

15

20

25

30

35

40

45

50

55

60

65

KDFGFRFSDTQRYNSIDEFYREVENQGYKLTFENI

SESYIDSVVNQGKLYLFQIYNKDFSAYSKGRPNLH

TLYWKALFDERNLQDVVYKLNGEAELFYRKQSIPK

KITHPAKEAIANKNKDNPKKESVFEYDLIKDKRFT

EDKFFFHCPITINFKSSGANKFNDEINLLLKEKAN

DVHILSIDRGERHLAYYTLVDGKGNIIKQDTFNII

GNDRMKTNYHDKLAAIEKDRDSARKDWKKINNIKE

MKEGYLSQVVHEIAKLVIEYNAIVVFADLNFGFKR

GRFKVEKQVYQKLEKMLIEKLNYLVFKDNEFDKTG

GVLRAYQLTAPFETFKKMGKQTGIIYYVPAGFTSK

ICPVTGFVNQLYPKYESVSKSQEFFSKFDKICYNL

DKGYFEFSFDYKNFGDKAAKGKWTIASFGSRLINF

RNSDKNHNWDTREVYPTKELEKLLKDYSIEYGHGE

CIKAAICGESDKKFFAKLTSVLNTILQMRNSKTGT

ELDYLISPVADVNGNFFDSRQAPKNMPQDAAANGA

YHIGLKGLMLLGRIKNNQEGKKLNLVIKNEEYFEF

VQNRNN

*Francisella novicida* Cpf1 D917A/
E1006A/D1255A (A917, A1006, and
A1255 are bolded and underlined)
MSIYQEFVNKYSLSKTLRFELIPQGKTLENIKARG

LILDDEKRAKDYKKAKQIIDKYHQFFIEEILSSVC

ISEDLLQNYSDVYFKLKKSDDDNLQKDFKSAKDTI

KKQISEYIKDSEKFKNLFNQNLIDAKKGQESDLIL

WLKQSKDNGIELFKANSDITDIDEALEEKSFKGWT

TYFKGFHENRKNVYSSNDIPTSITYRIVDDNLPKF

LENKAKYESLKDKAPEAINYEQIKKDLAEELTFDI

DYKTSEVNQRVFSLDEVFEIANFNNYLNQSGITKF

NTIIGGKFVNGENTKRKGINEYINLYSQQINDKTL

KKYKMSVLFKQILSDTESKSFVIDKLEDDSDVVTT

MQSFYEQIAAFKTVEEKSIKETLSLLFDDLKAQKL

DLSKIYFKNDKSLTDLSQQVFDDYSVIGTAVLEYI

TQQIAPKNLDNPSKKEQELIAKKTEKAKYLSLETI

KLALEEFNKHRDIDKQCRFEEILANFAAIPMIFDE

IAQNKDNLAQISIKYQNQGKKDLLQASAEDDVKAI

KDLLDQTNNLLHKLKIFHISQSEDKANILDKDEHF

YLVFEECYFELANIVPLYNKIRNYITQKPYSDEKF

KLNFENSTLANGWDKNKEPDNTAILFIKDDKYYLG

VMNKKNNKIFDDKAIKENKGEGYKKIVYKLLPGAN

KMLPKVFFSAKSIKFYNPSEDILRIRNHSTHTKNG

SPQKGYEKFEFNIEDCRKFIDFYKQSISKHPEWKD

FGFRFSDTQRYNSIDEFYREVENQGYKLTFENISE

SYIDSVVNQGKLYLFQIYNKDFSAYSKGRPNLHTL

WKALFDERNLQDVVYKLNGEAELFYRKQSIPKKIT

HPAKEAIANKNKDNPKKESVFEYDLIKDKRFTEDK

FFFHCPITINFKSSGANKFNDEINLLLKEKANDVM

LSIARGERHLAYYTLVDGKGNIIKQDTFNIIGNDR

MKTNYHDKLAAIEKDRDSARKDWKKINNIKEMKEG

YLSQVVHEIAKLVIEYNAIVVFADLNFGFKRGRFK

VEKQVYQKLEKMLIEKLNYLVFKDNEFDKTGGVLR

AYQLTAPFETFKKMGKQTGIIYYVPAGFTSKICPV

TGFVNQLYPKYESVSKSQEFFSKFDKICYNLDKGY

FEFSFDYKNFGDKAAKGKWTIASFGSRLINFRNSD

KNHNWDTREVYPTKELEKLLKDYSIEYGHGECIKA

AICGESDKKFFAKLTSVLNTILQMRNSKTGTELDY

LISPVADVNGNFFDSRQAPKNMPQDAAANGAYHIG

LKGLMLLGRIKNNQEGKKLNLVIKNEEYFEFVQNR

NN

In some embodiments, one of the Cas9 domains present in the fusion protein may be replaced with a guide nucleotide sequence-programmable DNA-binding protein domain that has no requirements for a PAM sequence.

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, Cas12b/C2c1, and Cas12c/C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (Cas12b/C2c1, and Cas12c/C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, Cas12b/C2c1, and Cas12c/C2c3, contain RuvC-like endonuclease domains related to Cpf1. A third system, contains an effector with two predicated HEPN RNase domains. Production of mature CRISPR RNA is tracrRNA-independent, unlike production of CRISPR RNA by Cas12b/C2c1. Cas12b/C2c1 depends on both CRISPR RNA and tracrRNA for DNA cleavage.

The crystal structure of *Alicyclobacillus acidoterrestris* Cas12b/C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with Cas12b/C2c1-mediated cleavage resulting in a staggered seven-nucleotide break of target DNA. Structural comparisons between Cas12b/C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a Cas12b/C2c1, or a Cas12c/C2c3 protein. In some embodiments, the napDNAbp is a Cas12b/C2c1 protein. In some embodiments, the napDNAbp is a Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12b/C2c1 or Cas12c/C2c3 protein. In some embodiments, the napDNAbp is a naturally-occurring Cas12b/C2c1 or Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that Cas12b/C2c1 or Cas12c/C2c3 from other bacterial species may also be used in accordance with the present disclosure.

```
Cas12b/C2c1
(uniprot.org/uniprot/T0D7A2#2)
sp|T0D7A2|C2C1_ALIAG CRISPR-
associated endo-nuclease C2c1
OS = Alicyclobacillus acido-terrestris
(strain ATCC 49025/DSM 3922/
CIP 106132/NCIMB 13137/GD3B)
GN = c2c1 PE = 1 SV = 1
MAVKSIKVKLRLDDMPEIRAGLWKLHKEVNAGVRYY

TEWLSLLRQENLYRRSPNGDGEQECDKTAEECKAE

LLERLRARQVENGHRGPAGSDDELLQLARQLYELL

VPQAIGAKGDAQQIARKFLSPLADKDAVGGLGIAK

AGNKPRWVRMREAGEPGWEEEKEKAETRKSADRTA

DVLRALADFGLKPLMRVYTDSEMSSVEWKPLRKGQ

AVRTWDRDMFQQAIERMMSWESWNQRVGQEYAKLV

EQKNRFEQKNFVGQEHLVFILVNQLQQDMKEASPG

LESKEQTAHYVTGRALRGSDKVFEKWGKLAPDAPF

DLYDAEIKNVQRRNTRRFGSHDLFAKLAEPEYQAL

WREDASFLTRYAVYNSILRKLNHAKMFATFTLPDA

TAHPIWTRFDKLGGNLHQYTFLFNEFGERRHAIRF

HKLLKVENGVAREVDDVTVPISMSEQLDNLLPRDP

NEPIALYFRDYGAEQFIFTGEFGGAKIQCRRDQLA

HMHRRRGARDVYLNVSVRVQSQSEARGERRPPYAA

VFRLVGDNHRAFVHFDKLSDYLAEHPDDGKLGSEG

LLSGLRVMSVDLGLRTSASISVFRVARKDELKPNS

KGRVPFFFPIKGNDNLVAVHERSQLLKLPGETESK
```

```
-continued

DLRAIREERQRTLRQLRTQLAYLRLLVRCGSEDVG

RRERSWAKLIEQPVDAANHMTPDWREAFENELQKL

KSLHGICSDKEWMDAVYESVRRVWRHMGKQVRDVV

RKDVRSGERPKIRGYAKDVVGGNSIEQIEYLERQY

KFLKSWSFFGKVSGQVIRAEKGSRFAITLREHIDH

AKEDRLKKLADRIIMEALGYVYALDERGKGKWVAK

YPPCQLILLEELSEYQFNNDRPPSENNQLMQWSHR

GVFQELINQAQVHDLLVGTMYAAFSSRFDARTGAP

GIRCRRVPARCTQEHNPEPFPWVVLNKFVVEHTLD

ACPLRADDLIPTGEGEIFVSPFSAEEGDFHQIHAD

LNAAQNLQQRLWSDFDISQIRLRCDWGEVDGELVL

IPRLTGKRTADSYSNKVFYTNTGVTYYERERGKKR

RKVFAQEKLSEEEAELLVEADEAREKSVVLMRDPS

GIINRGNWTRQKEFVVSMVNQRIEGYLVKQIRSRV

PLQDSACENTGDI
```

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of an nCas9 domain or a dCas9 domain. In some embodiments, the NLS is fused to the N-terminus of the deaminase. In some embodiments, the NLS is fused to the C-terminus of the deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFES PKKKRKV (SEQ ID NO: 178), KRTADGSEFESPKKKRKV (SEQ ID NO: 88), KRPAATKKAGQAKKKK (SEQ ID NO: 89), KKTELQTTNAENKTKKL (SEQ ID NO: 90), KRGIN-DRNFWRGENGRKTR (SEQ ID NO: 91), RKSGKIAAIV-VKRPRKPKKKRKV (SEQ ID NO: 179), or MDSLL-MNRRKFLYQFKNVRWAKGRRETYLC (SEQ ID NO: 94).

In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 89), is the prototype of the ubiquitous bipartite signal: two clusters of basic amino acids, separated by a spacer of about 10 amino acids. The sequence of an exemplary bipartite NLS follows:

PKKKRKVEGADKRTADGSEFES PKKKRKV (SEQ ID NO: 178)

In some embodiments, the fusion proteins of the invention do not comprise a linker sequence. In some embodiments, linker sequences between one or more of the domains or proteins are present.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, mye-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Linkers

In certain embodiments, linkers may be used to link any of the peptides or peptide domains of the invention. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length.

Cas9 Complexes with Guide RNAs

Some aspects of this disclosure provide complexes comprising any of the fusion proteins provided herein, and a guide RNA. Any method for linking the fusion protein domains can be employed (e.g., ranging from very flexible linkers of the form $(GGGS)_n$ (SEQ ID NO: 106), $(GGGGS)_n$ (SEQ ID NO: 107), and $(G)_n$ to more rigid linkers of the form $(EAAAK)_n$ (SEQ ID NO: 108), $(SGGS)_n$ (SEQ ID NO: 80), SGSETPGTSESATPES (SEQ ID NO: 8) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference) and (XP)~) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif, wherein n is 1, 3, or 7 (SEQ ID NO: 180). In some embodiments, the Cas9 domain of the fusion proteins provided herein are fused via a linker comprising the amino acid sequence SGSETPGTSESATPES (SEQ ID NO: 8):

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 1).

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Methods of Using Fusion Proteins Comprising a Cytidine Deaminase, Adenosine Deaminase and a Cas9 Domain Some aspects of this disclosure provide methods of using the fusion proteins, or complexes provided herein. For example, some aspects of this disclosure provide methods comprising contacting a DNA molecule encoding a mutation with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins comprising a Cas9 domain and a cytidine deaminase or an adenosine deaminase, as disclosed herein, to a target site, e.g., a site comprising a mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Base Editor Efficiency

The fusion proteins of the invention advantageously modify a specific nucleotide base comprising a mutation without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., mutations) versus indels. In some embodiments, the base editors provided herein are capable of generating a ratio of intended mutation to indels that is greater than 1:1. In some embodiments, the base editors provided herein are capable of generating a ratio of intended mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation in a nucleic acid (e.g. a nucleic acid within a genome of a subject) without generating a significant number of unintended mutations. In some embodiments, an intended mutation is a mutation that is generated by a specific base editor bound to a gRNA, specifically designed to alter or correct a mutation. In some embodiments, any of the base editors provided herein are capable of generating a ratio of intended mutations to unintended mutations (e.g., intended mutations: unintended mutations) that is greater than 1:1. In some embodiments, any of the base editors provided herein are capable of generating a ratio of intended mutations to unintended mutations that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid molecule encoding a polypeptide of interest (e.g., the expression product of a disease gene). In some embodiments, the method comprises the steps of: a) contacting a target region of a nucleic acid (e.g., a double-stranded DNA sequence) with a complex comprising a base editor and a guide nucleic acid (e.g., gRNA), b) inducing strand separation of said target region, c) converting a first nucleobase of said target nucleobase pair in a single strand of the target region to a second nucleobase, and d) cutting no more than one strand of said target region using the nCas9, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., G·C to A·T). In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a dCas9 domain. In some embodiments, the base editor protects or binds the non-edited strand. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In one embodiment, the linker is 32 amino acids in length. In another embodiment, a "long linker" is at least about 60 amino acids in length. In other embodiments, the linker is between about 3-100 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein.

In some embodiments, the disclosure provides methods for editing a nucleotide (e.g., a SNP). In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Multiplex Editing

In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more gene, wherein at least one gene is located in a different locus. In some embodiments, the multiplex editing can comprise one or more guide polynucleotides. In some embodiments, the multiplex editing can comprise one or more base editor system. In some embodiments, the multiplex editing can comprise one or more base editor systems with a single guide polynucleotide. In some embodiments, the multiplex editing can comprise one or more base editor system with a plurality of guide polynucleotides. In some embodiments, the multiplex editing can comprise one or more guide polynucleotide with a single base editor system. In some embodiments, the multiplex editing can comprise at least one guide polynucleotide that does not require a PAM sequence to target binding to a target polynucleotide sequence. In some embodiments, the multiplex editing can comprise at least one guide polynucleotide that requires a PAM sequence to target binding to a target polynucleotide sequence. In some embodiments, the multiplex editing can comprise a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editor provided herein. It should also be appreciated that the multiplex editing using any of the base editors as described herein can comprise a sequential editing of a plurality of nucleobase pairs.

In some embodiments, the plurality of nucleobase pairs are in one more genes. In some embodiments, the plurality of nucleobase pairs is in the same gene. In some embodiments, at least one gene in the one more genes is located in a different locus.

In some embodiments, the editing is editing of the plurality of nucleobase pairs in at least one protein coding region. In some embodiments, the editing is editing of the plurality of nucleobase pairs in at least one protein non-coding region. In some embodiments, the editing is editing of the plurality of nucleobase pairs in at least one protein coding region and at least one protein non-coding region.

In some embodiments, the editing is in conjunction with one or more guide polynucleotides. In some embodiments, the base editor system can comprise one or more base editor system. In some embodiments, the base editor system can comprise one or more base editor systems in conjunction with a single guide polynucleotide. In some embodiments, the base editor system can comprise one or more base editor system in conjunction with a plurality of guide polynucleotides. In some embodiments, the editing is in conjunction with one or more guide polynucleotide with a single base editor system. In some embodiments, the editing is in conjunction with at least one guide polynucleotide that does not require a PAM sequence to target binding to a target polynucleotide sequence. In some embodiments, the editing is in conjunction with at least one guide polynucleotide that require a PAM sequence to target binding to a target polynucleotide sequence. In some embodiments, the editing is in conjunction with a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editors provided herein. It should also be appreciated that the editing can comprise a sequential editing of a plurality of nucleobase pairs.

Expression of Fusion Proteins in a Host Cell

Fusion proteins of the invention may be expressed in virtually any host cell of interest, including but not limited to bacteria, yeast, fungi, insects, plants, and animal cells using routine methods known to the skilled artisan. For example, a DNA encoding a fusion protein of the invention can be cloned by designing suitable primers for the upstream and downstream of CDS based on the cDNA sequence. The cloned DNA may be directly, or after digestion with a restriction enzyme when desired, or after addition of a suitable linker and/or a nuclear localization signal ligated with a DNA encoding one or more additional components of a base editing system. The base editing system is translated in a host cell to form a complex.

Fusion proteins are generated by operably linking one or more polynucleotides encoding one or more domains having nucleobase modifying activity (e.g., an adenosine deaminase, cytidine deaminase, DNA glycosylase) to a polynucleotide encoding a napDNAbp to prepare a polynucleotide that encodes a fusion protein of the invention. In some embodiments, a polynucleotide encoding a napDNAbp, and a DNA encoding a domain having nucleobase modifying activity may each be fused with a DNA encoding a binding domain or a binding partner thereof, or both DNAs may be fused with a DNA encoding a separation intein, whereby the nucleic acid sequence-recognizing conversion module and the nucleic acid base converting enzyme are translated in a host cell to form a complex. In these cases, a linker and/or a nuclear localization signal can be linked to a suitable position of one of or both DNAs when desired.

A DNA encoding a protein domain described herein can be obtained by chemically synthesizing the DNA, or by connecting synthesized partly overlapping oligoDNA short chains by utilizing the PCR method and the Gibson Assembly method to construct a DNA encoding the full length thereof. The advantage of constructing a full-length DNA by chemical synthesis or a combination of PCR method or Gibson Assembly method is that the codon to be used can be designed in CDS full-length according to the host into which the DNA is introduced. In the expression of a heterologous DNA, the protein expression level is expected to increase by converting the DNA sequence thereof to a codon highly frequently used in the host organism. As the data of codon use frequency in host to be used, for example, the genetic code use frequency database (kazusa.or.jp/codon/index-.html) disclosed in the home page of Kazusa DNA Research Institute can be used, or documents showing the codon use frequency in each host may be referred to. By reference to the obtained data and the DNA sequence to be introduced, codons showing low use frequency in the host from among those used for the DNA sequence may be converted to a codon coding the same amino acid and showing high use frequency.

An expression vector containing a DNA encoding a nucleic acid sequence-recognizing module and/or a nucleic acid base converting enzyme can be produced, for example, by linking the DNA to the downstream of a promoter in a suitable expression vector.

As the expression vector, *Escherichia coli*-derived plasmids (e.g., pBR322, pBR325, pUC12, pUC13); *Bacillus subtilis*-derived plasmids (e.g., pUB110, pTP5, pC194); yeast-derived plasmids (e.g., pSH19, pSH15); insect cell expression plasmids (e.g., pFast-Bac); animal cell expression plasmids (e.g., pA1-11, pXT1, pRc/CMV, pRc/RSV, pcDNAI/Neo); bacteriophages such as .lamda.phage and the like; insect virus vectors such as baculovirus and the like (e.g., BmNPV, AcNPV); animal virus vectors such as retrovirus, vaccinia virus, adenovirus and the like, and the like are used.

As the promoter, any promoter appropriate for a host to be used for gene expression can be used. In a conventional method using DSB, since the survival rate of the host cell sometimes decreases markedly due to the toxicity, it is desirable to increase the number of cells by the start of the induction by using an inductive promoter. However, since sufficient cell proliferation can also be afforded by expressing the nucleic acid-modifying enzyme complex of the present invention, a constitution promoter can also be used without limitation.

For example, when the host is an animal cell, SR.alpha. promoter, SV40 promoter, LTR promoter, CMV (cytomegalovirus) promoter, RSV (Rous sarcoma virus) promoter, MoMuLV (Moloney mouse leukemia virus) LTR, HSV-TK (simple herpes virus thymidine kinase) promoter and the like are used. Of these, CMV promoter, SR.alpha promoter and the like are preferable. In one embodiment, the promoter is CMV promoter or SR alpha promoter. When the host cell is *Escherichia coli*, any of the following promoters may be used: trp promoter, lac promoter, recA promoter, lamda.P-.sub.L promoter, lpp promoter, T7 promoter and the like. When the host is genus *Bacillus*, any of the following promoters may be used: SPO1 promoter, SPO2 promoter, penP promoter and the like. When the host is a yeast, any of the following promoters may be used: Gal1/10 promoter, PHO5 promoter, PGK promoter, GAP promoter, ADH promoter and the like. When the host is an insect cell, any of the following promoters may be used polyhedrin promoter, P10 promoter and the like. When the host is a plant cell, any of the following promoters may be used: CaMV35S promoter, CaMV19S promoter, NOS promoter and the like.

In some embodiments, the expression vector may contain an enhancer, splicing signal, terminator, polyA addition signal, a selection marker such as drug resistance gene, auxotrophic complementary gene and the like, replication origin and the like on demand.

An RNA encoding a protein domain described herein can be prepared by, for example, transcription to mRNA in a vitro transcription system known per se by using a vector encoding DNA encoding the above-mentioned nucleic acid sequence-recognizing module and/or a nucleic acid base converting enzyme as a template.

A fusion protein of the invention can be expressed by introducing an expression vector encoding a fusion protein into a host cell, and culturing the host cell. Host cells useful in the invention include bacterial cells, yeast, insect cells, mammalian cells and the like.

The genus *Escherichia* includes *Escherichia coli* K12.cndot.DH1 (Proc. Natl. Acad. Sci. USA, 60, 160 (1968)], *Escherichia coli* JM103 (Nucleic Acids Research, 9, 309 (1981)], *Escherichia coli* JA221 (Journal of Molecular Biology, 120, 517 (1978)], *Escherichia coli* HB101 (Journal of Molecular Biology, 41, 459 (1969)], *Escherichia coli* C600 (Genetics, 39, 440 (1954)] and the like.

The genus *Bacillus* includes *Bacillus subtilis* M1114 (Gene, 24, 255 (1983)], *Bacillus subtilis* 207-21 (Journal of Biochemistry, 95, 87 (1984)] and the like.

Yeast useful for expressing fusion proteins of the invention include *Saccharomyces cerevisiae* AH22, AH22R.sup.-, NA87-11A, DKD-5D, 20B-12, *Schizosaccharomyces pombe* NCYC1913, NCYC2036, *Pichia pastoris* KM71 and the like.

Fusion proteins are expressed in insect cells using, for example, viral vectors, such as AcNPV. Insect host cells include any of the following cell lines: cabbage armyworm larva-derived established line (*Spodoptera frugiperda* cell; Sf cell), MG1 cells derived from the mid-intestine of *Trichoplusia ni*, High Five™ cells derived from an egg of *Trichoplusia ni*, *Mamestra brassicae*-derived cells, Estigmena acrea-derived cells and the like are used. When the virus is BmNPV, cells of *Bombyx mori*-derived established line (*Bombyx mori* N cell; BmN cell) and the like are used as insect cells. As the Sf cell, for example, Sf9 cell (ATCC CRL1711), Sf21 cell (all above, In Vivo, 13, 213-217 (1977)] and the like.

As the insect, for example, larva of *Bombyx mori, Drosophila*, cricket and the like are used to express fusion proteins (Nature, 315, 592 (1985)).

Mammalian cell lines may be used to express fusion proteins. Such cell lines include monkey COS-7 cell, monkey Vero cell, Chinese hamster ovary (CHO) cell, dhfr gene-deficient CHO cell, mouse L cell, mouse AtT-20 cell, mouse myeloma cell, rat GH3 cell, human FL cell and the like, pluripotent stem cells such as iPS cell, ES cell and the like of human and other mammals, and primary cultured cells prepared from various tissues are used. Furthermore, zebrafish embryo, *Xenopus* oocyte and the like can also be used.

Plant cells may be maintained in culture using methods well known to the skilled artisan. Plant cell culture involves suspending cultured cells, callus, protoplast, leaf segment, root segment and the like prepared from various plants (e.g., grain such as rice, wheat, corn and the like, product crops such as tomato, cucumber, eggplant, carnations, *Eustoma russellianum*, tobacco, *Arabidopsis thaliana*).

All the above-mentioned host cells may be haploid (monoploid), or polyploid (e.g., diploid, triploid, tetraploid and the like). In the conventional mutation introduction methods, mutation is, in principle, introduced into only one homologous chromosome to produce a hetero gene type. Therefore, desired phenotype is not expressed unless dominant mutation occurs, and homozygousness inconveniently requires labor and time. In contrast, according to the present invention, since mutation can be introduced into any allele on the homologous chromosome in the genome, desired phenotype can be expressed in a single generation even in the case of recessive mutation, which is extremely useful since the problem of the conventional method can be solved.

Expression vectors encoding a fusion protein of the invention are introduced into host cells using any transfection method (e.g., lysozyme method, competent method, PEG method, CaCl₂ coprecipitation method, electroporation method, the microinjection method, the particle gun method, lipofection method, *Agrobacterium* method and the like). The transfection method is selected based on the host cell to be transfected.

*Escherichia coli* can be transformed according to the methods described in, for example, Proc. Natl. Acad. Sci. USA, 69, 2110 (1972), Gene, 17, 107 (1982) and the like. The genus *Bacillus* can be introduced into a vector according to the methods described in, for example, Molecular & General Genetics, 168, 111 (1979) and the like. Yeast cells can be introduced into a vector according to the methods described in, for example, Methods in Enzymology, 194, 182-187 (1991), Proc. Natl. Acad. Sci. USA, 75, 1929 (1978) and the like. Insect cells can be introduced into a vector according to the methods described in, for example, Bio/Technology, 6, 47-55 (1988) and the like. Mammalian cells can be introduced into a vector according to the methods described in, for example, Cell Engineering additional volume 8, New Cell Engineering Experiment Protocol, 263-267 (1995) (published by Shujunsha), and Virology, 52, 456 (1973).

Cells comprising expression vectors of the invention are cultured according to known methods, which vary depending on the host. For example, when *Escherichia coli* or genus *Bacillus* are cultured, a liquid medium is preferable as a medium to be used for the culture. The medium preferably contains a carbon source, nitrogen source, inorganic substance and the like necessary for the growth of the transformant. Examples of the carbon source include glucose, dextrin, soluble starch, sucrose and the like; examples of the nitrogen source include inorganic or organic substances such as ammonium salts, nitrate salts, corn steep liquor, peptone, casein, meat extract, soybean cake, potato extract and the like; and examples of the inorganic substance include calcium chloride, sodium dihydrogen phosphate, magnesium chloride and the like. The medium may contain yeast extract, vitamins, growth promoting factor and the like. The pH of the medium is preferably about 5-about 8.

As a medium for culturing *Escherichia coli*, for example, M9 medium containing glucose, casamino acid (Journal of Experiments in Molecular Genetics, 431-433, Cold Spring Harbor Laboratory, New York 1972] is preferable. Where necessary, for example, agents such as 3.beta.-indolylacrylic acid may be added to the medium to ensure an efficient function of a promoter. *Escherichia coli* is cultured at generally about 15-about 43° C. Where necessary, aeration and stirring may be performed.

The genus *Bacillus* is cultured at generally about 30-about 40° C. Where necessary, aeration and stirring may be performed.

Examples of the medium for culturing yeast include Burkholder minimum medium (Proc. Natl. Acad. Sci. USA, 77, 4505 (1980)], SD medium containing 0.5% casamino acid (Proc. Natl. Acad. Sci. USA, 81, 5330 (1984)] and the like. The pH of the medium is preferably about 5-about 8. The culture is performed at generally about 20° C.-about 35° C. Where necessary, aeration and stirring may be performed.

As a medium for culturing an insect cell or insect, for example, Grace's Insect Medium (Nature, 195, 788 (1962)] containing an additive such as inactivated 10% bovine serum and the like as appropriate and the like are used. The pH of the medium is preferably about 6.2 to about 6.4. The culture is performed at generally about 27° C. Where necessary, aeration and stirring may be performed.

As a medium for culturing an animal cell, for example, minimum essential medium (MEM) containing about 5-about 20% of fetal bovine serum (Science, 122, 501 (1952)], Dulbecco's modified Eagle medium (DMEM) (Virology, 8, 396 (1959)], RPMI 1640 medium (The Journal of the American Medical Association, 199, 519 (1967)], 199 medium (Proceeding of the Society for the Biological Medicine, 73, 1 (1950)] and the like are used. The pH of the medium is preferably about 6-about 8. The culture is performed at generally about 30° C. to about 40° C. Where necessary, aeration and stirring may be performed.

As a medium for culturing a plant cell, for example, MS medium, LS medium, B5 medium and the like are used. The pH of the medium is preferably about 5-about 8. The culture is performed at generally about 20° C.-about 30° C. Where necessary, aeration and stirring may be performed.

When a higher eukaryotic cell, such as animal cell, insect cell, plant cell and the like is used as a host cell, a DNA encoding a base editing system of the present invention is introduced into a host cell under the regulation of an inducible promoter (e.g., metallothionein promoter (induced by heavy metal ion), heat shock protein promoter (induced by heat shock), Tet-ON/Tet-OFF system promoter (induced by addition or removal of tetracycline or a derivative thereof), steroid-responsive promoter (induced by steroid hormone or a derivative thereof) etc.), the induction substance is added to the medium (or removed from the medium) at an appropriate stage to induce expression of the nucleic acid-modifying enzyme complex, culture is performed for a given period to carry out a base editing and, introduction of a mutation into a target gene, transient expression of the base editing system can be realized.

Prokaryotic cells such as *Escherichia coli* and the like can utilize an inducible promoter. Examples of the inducible promoter include, but are not limited to, lac promoter (induced by IPTG), cspA promoter (induced by cold shock), araBAD promoter (induced by arabinose) and the like.

Alternatively, the above-mentioned inductive promoter can also be utilized as a vector removal mechanism when higher eukaryotic cells, such as animal cell, insect cell, plant cell and the like are used as a host cell. That is, a vector is mounted with a replication origin that functions in a host cell, and a nucleic acid encoding a protein necessary for replication (e.g., SV40 on and large T antigen, oriP and EBNA-1 etc. for animal cells), of the expression of the nucleic acid encoding the protein is regulated by the above-mentioned inducible promoter. As a result, while the vector is autonomously replicatable in the presence of an induction substance, when the induction substance is removed, autonomous replication is not available, and the vector naturally falls off along with cell division (autonomous replication is not possible by the addition of tetracycline and doxycycline in Tet-OFF system vector).

Delivery System

Nucleic Acid-Based Delivery of a Nucleobase Editors and gRNAs

Nucleic acids encoding base editing systems (e.g., multi-effector nucleobase editor) according to the present disclosure can be administered to subjects or delivered into cells in vitro or in vivo by art-known methods or as described herein. In one embodiment, nucleobase editors or multi-effector nucleobase editors can be delivered by, e.g., vectors (e.g., viral or non-viral vectors), non-vector based methods (e.g., using naked DNA, DNA complexes, lipid nanoparticles), or a combination thereof.

Nucleic acids encoding nucleobase editors or multi-effector nucleobase editors can be delivered directly to cells (e.g., hematopoietic cells or their progenitors, hematopoietic stem cells, and/or induced pluripotent stem cells) as naked DNA or RNA, for instance by means of transfection or electroporation, or can be conjugated to molecules (e.g., N-acetylgalactosamine) promoting uptake by the target cells. Nucleic acid vectors, such as the vectors described herein can also be used.

Nucleic acid vectors can comprise one or more sequences encoding a domain of a fusion protein described herein. A vector can also comprise a sequence encoding a signal peptide (e.g., for nuclear localization, nucleolar localization, or mitochondrial localization), associated with (e.g., inserted into or fused to) a sequence coding for a protein. As one example, a nucleic acid vectors can include a Cas9 coding sequence that includes one or more nuclear localization sequences (e.g., a nuclear localization sequence from SV40), and deaminase (e.g., an adenosine deaminase and/or cytidine deaminase).

The nucleic acid vector can also include any suitable number of regulatory/control elements, e.g., promoters, enhancers, introns, polyadenylation signals, Kozak consensus sequences, or internal ribosome entry sites (IRES). These elements are well known in the art. For hematopoietic cells suitable promoters can include IFNbeta or CD45.

Nucleic acid vectors according to this disclosure include recombinant viral vectors. Exemplary viral vectors are set forth herein. Other viral vectors known in the art can also be used. In addition, viral particles can be used to deliver base editing system components in nucleic acid and/or peptide form. For example, "empty" viral particles can be assembled to contain any suitable cargo. Viral vectors and viral particles can also be engineered to incorporate targeting ligands to alter target tissue specificity.

In addition to viral vectors, non-viral vectors can be used to deliver nucleic acids encoding genome editing systems according to the present disclosure. One important category of non-viral nucleic acid vectors are nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/ or gene transfer are shown in Table 6 (below).

TABLE 6

| Lipids Used for Gene Transfer | | |
| --- | --- | --- |
| Lipid | Abbreviation | Feature |
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 20c | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl] trimethylammoniun bromide | CLIP-6 | Cationic |
| Ethyldimyristoylphosphatidylcholine | EDNIPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |

US 12,612,618 B2

183

TABLE 6-continued

Lipids Used for Gene Transfer

| Lipid | Abbreviation | Feature |
|---|---|---|
| N-t-Butyl-N0-tetradecyl-3-tetradecylaminopropionamidine | di C14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 7 lists exemplary polymers for use in gene transfer and/or nanoparticle formulations.

TABLE 7

Polymers Used for Gene Transfer

| Polymer | Abbreviation |
|---|---|
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |

184

TABLE 7-continued

Polymers Used for Gene Transfer

| Polymer | Abbreviation |
|---|---|
| Poly(α[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly(2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 8 summarizes delivery methods for a polynucleotide encoding a fusion protein described herein.

TABLE 8

| Delivery | Vector/Mode | Delivery into Non-Dividing Cells | Duration of Expression | Genome Integration | Type of Molecule Delivered |
|---|---|---|---|---|---|
| Physical | (e.g., electroporation, particle gun, Calcium Phosphate transfection | YES | Transient | NO | Nucleic Acids and Proteins |
| Viral | Retrovirus | NO | Stable | YES | RNA |
| | Lentivirus | YES | Stable | YES/NO with modification | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |

TABLE 8-continued

| Delivery | Vector/Mode | Delivery into Non-Dividing Cells | Duration of Expression | Genome Integration | Type of Molecule Delivered |
|---|---|---|---|---|---|
| | Biological liposomes: Erythrocyte Ghosts and Exosomes | YES | Transient | NO | Nucleic Acids |

In another aspect, the delivery of genome editing system components or nucleic acids encoding such components, for example, a nucleic acid binding protein such as, for example, Cas9 or variants thereof, and a gRNA targeting a genomic nucleic acid sequence of interest, may be accomplished by delivering a ribonucleoprotein (RNP) to cells. The RNP comprises the nucleic acid binding protein, e.g., Cas9, in complex with the targeting gRNA. RNPs may be delivered to cells using known methods, such as electroporation, nucleofection, or cationic lipid-mediated methods, for example, as reported by Zuris, J. A. et al., 2015, *Nat. Biotechnology*, 33(1):73-80. RNPs are advantageous for use in CRISPR base editing systems, particularly for cells that are difficult to transfect, such as primary cells. In addition, RNPs can also alleviate difficulties that may occur with protein expression in cells, especially when eukaryotic promoters, e.g., CMV or EF1A, which may be used in CRISPR plasmids, are not well-expressed. Advantageously, the use of RNPs does not require the delivery of foreign DNA into cells. Moreover, because an RNP comprising a nucleic acid binding protein and gRNA complex is degraded over time, the use of RNPs has the potential to limit off-target effects. In a manner similar to that for plasmid based techniques, RNPs can be used to deliver binding protein (e.g., Cas9 variants) and to direct homology directed repair (HDR).

A promoter used to drive base editor coding nucleic acid molecule expression can include AAV ITR. This can be advantageous for eliminating the need for an additional promoter element, which can take up space in the vector. The additional space freed up can be used to drive the expression of additional elements, such as a guide nucleic acid or a selectable marker. ITR activity is relatively weak, so it can be used to reduce potential toxicity due to over expression of the chosen nuclease.

Any suitable promoter can be used to drive expression of the base editor and, where appropriate, the guide nucleic acid. For ubiquitous expression, promoters that can be used include CMV, CAG, CBh, PGK, SV40, Ferritin heavy or light chains, etc. For brain or other CNS cell expression, suitable promoters can include: SynapsinI for all neurons, CaMKIIalpha for excitatory neurons, GAD67 or GAD65 or VGAT for GABAergic neurons, etc. For liver cell expression, suitable promoters include the Albumin promoter. For lung cell expression, suitable promoters can include SP-B. For endothelial cells, suitable promoters can include ICAM. For hematopoietic cells suitable promoters can include IFN-beta or CD45. For Osteoblasts suitable promoters can include OG-2.

In some embodiments, a base editor of the present disclosure is of small enough size to allow separate promoters to drive expression of the base editor and a compatible guide nucleic acid within the same nucleic acid molecule. For instance, a vector or viral vector can comprise a first promoter operably linked to a nucleic acid encoding the base editor and a second promoter operably linked to the guide nucleic acid.

The promoter used to drive expression of a guide nucleic acid can include: Pol III promoters such as U6 or H1 Use of Pol II promoter and intronic cassettes to express gRNA Adeno Associated Virus (AAV).

Viral Vectors

A base editor described herein can therefore be delivered with viral vectors. In some embodiments, a base editor disclosed herein can be encoded on a nucleic acid that is contained in a viral vector. In some embodiments, one or more components of the base editor system can be encoded on one or more viral vectors. For example, a base editor and guide nucleic acid can be encoded on a single viral vector. In other embodiments, the base editor and guide nucleic acid are encoded on different viral vectors. In either case, the base editor and guide nucleic acid can each be operably linked to a promoter and terminator. The combination of components encoded on a viral vector can be determined by the cargo size constraints of the chosen viral vector.

The use of RNA or DNA viral based systems for the delivery of a base editor takes advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells can optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

Viral vectors can include lentivirus (e.g., HIV and FIV-based vectors), Adenovirus (e.g., AD100), Retrovirus (e.g., Maloney murine leukemia virus, MML-V), herpesvirus vectors (e.g., HSV-2), and Adeno-associated viruses (AAVs), or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific base editing, the expression of the base editor and optional guide nucleic acid can be driven by a cell-type specific promoter.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (See, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

Retroviral vectors, especially lentiviral vectors, can require polynucleotide sequences smaller than a given length for efficient integration into a target cell. For example, retroviral vectors of length greater than 9 kb can result in low viral titers compared with those of smaller size. In some embodiments, a base editor of the present disclosure is of sufficient size so as to enable efficient packaging and delivery into a target cell via a retroviral vector. In some embodiments, a base editor is of a size so as to allow efficient packing and delivery even when expressed together with a guide nucleic acid and/or other components of a targetable nuclease system.

In applications where transient expression is preferred, adenoviral based systems can be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors can also be used to transduce cells with target nucleic acids, e.g., in the in vitro production of nucleic acids and peptides, and for in vivo and ex vivo gene therapy procedures (See, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vp1, Vp2, and Vp3, produced in a 1:1:10 ratio from the same open reading frame but from differential splicing (Vp1) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vp1.

Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the invention and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

Viral vectors can be selected based on the application. For example, for in vivo gene delivery, AAV can be advantageous over other viral vectors. In some embodiments, AAV allows low toxicity, which can be due to the purification method not requiring ultra-centrifugation of cell particles that can activate the immune response. In some embodiments, AAV allows low probability of causing insertional mutagenesis because it doesn't integrate into the host genome. Adenoviruses are commonly used as vaccines because of the strong immunogenic response they induce. Packaging capacity of the viral vectors can limit the size of the base editor that can be packaged into the vector.

AAV has a packaging capacity of about 4.5 Kb or 4.75 Kb including two 145 base inverted terminal repeats (ITRs). This means disclosed base editor as well as a promoter and transcription terminator can fit into a single viral vector. Constructs larger than 4.5 or 4.75 Kb can lead to significantly reduced virus production. For example, SpCas9 is quite large, the gene itself is over 4.1 Kb, which makes it difficult for packing into AAV. Therefore, embodiments of the present disclosure include utilizing a disclosed base editor which is shorter in length than conventional base editors. In some examples, the base editors are less than 4 kb. Disclosed base editors can be less than 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb. In some embodiments, the disclosed base editors are 4.5 kb or less in length.

An AAV can be AAV1, AAV2, AAV5 or any combination thereof. One can select the type of AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. A tabulation of certain AAV serotypes as to these cells can be found in Grimm, D. et al, J. Virol. 82: 5887-5911 (2008)).

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses can be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without anti- biotics. After 20 hours, media is changed to OptiMEM (serum-free) media and transfection was done 4 hours later. Cells are transfected with 10 μg of lentiviral transfer plasmid (pCasES10) and the following packaging plasmids: 5 μg of pMD2.G (VSV-g pseudotype), and 7.5 μg of psPAX2 (gag/ pol/rev/tat). Transfection can be done in 4 mL OptiMEM with a cationic lipid delivery agent (50 μl Lipofectamine® 2000 transfection reagent and 100 ul Plus reagent). After 6 hours, the media is changed to antibiotic-free DMEM with 10% fetal bovine serum. These methods use serum during cell culture, but serum-free methods are preferred.

Lentivirus can be purified as follows. Viral supernatants are harvested after 48 hours. Supernatants are first cleared of debris and filtered through a 0.45 μm low protein binding (PVDF) filter. They are then spun in an ultracentrifuge for 2 hours at 24,000 rpm. Viral pellets are resuspended in 50 μl of DMEM overnight at 4° C. They are then aliquoted and immediately frozen at −80° C.

In another embodiment, minimal non-primate lentiviral vectors based on the equine infectious anemia virus (EIAV) are also contemplated. In another embodiment, RetinoStat®, an equine infectious anemia virus-based lentiviral gene therapy vector that expresses angiostatic proteins endostatin and angiostatin that is contemplated to be delivered via a subretinal injection. In another embodiment, use of self- inactivating lentiviral vectors are contemplated.

Any RNA of the systems, for example a guide RNA or a base editor-encoding mRNA, can be delivered in the form of RNA. Base editor-encoding mRNA can be generated using in vitro transcription. For example, nuclease mRNA can be synthesized using a PCR cassette containing the following elements: T7 promoter, optional kozak sequence (GC-CACC), nuclease sequence, and 3′ UTR such as a 3′ UTR from beta globin-polyA tail. The cassette can be used for transcription by T7 polymerase. Guide polynucleotides (e.g., gRNA) can also be transcribed using in vitro tran-scription from a cassette containing a T7 promoter, followed by the sequence "GG", and guide polynucleotide sequence.

To enhance expression and reduce possible toxicity, the base editor-coding sequence and/or the guide nucleic acid can be modified to include one or more modified nucleoside e.g. using pseudo-U or 5-Methyl-C.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. In one embodiment, inteins are utilized to join fragments or portions of a multi-effector base editor protein that is grafted onto an AAV capsid protein. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice them-selves out and simultaneously ligate the flanking N- and C-terminal exteins of the protein fragments to which they were fused, thereby reconstituting a full-length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In one embodiment, dual AAV vectors are generated by splitting a large transgene expression cassette in two sepa-rate halves (5′ and 3′ ends, or head and tail), where each half of the cassette is packaged in a single AAV vector (of <5 kb). The re-assembly of the full-length transgene expression cassette is then achieved upon co-infection of the same cell by both dual AAV vectors followed by: (1) homologous recombination (HR) between 5′ and 3′ genomes (dual AAV overlapping vectors); (2) ITR-mediated tail-to-head con-catemerization of 5′ and 3′ genomes (dual AAV trans-splicing vectors); or (3) a combination of these two mecha-nisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

Inteins

In some embodiments, a portion or fragment of a nuclease (e.g., Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nucle-ase-capsid, capsid-intein-nuclease, etc.). In some embodi-ments, the N-terminus of an intein is fused to the C-terminus of a fusion protein and the C-terminus of the intein is fused to the N-terminus of an AAV capsid protein.

Inteins (intervening protein) are auto-processing domains found in a variety of diverse organisms, which carry out a process known as protein splicing. Protein splicing is a multi-step biochemical reaction comprised of both the cleav-age and formation of peptide bonds. While the endogenous substrates of protein splicing are proteins found in intein-containing organisms, inteins can also be used to chemically manipulate virtually any polypeptide backbone.

In protein splicing, the intein excises itself out of a precursor polypeptide by cleaving two peptide bonds, thereby ligating the flanking extein (external protein) sequences via the formation of a new peptide bond. This rearrangement occurs post-translationally (or possibly co-translationally). Intein-mediated protein splicing occurs spontaneously, requiring only the folding of the intein domain.

About 5% of inteins are split inteins, which are tran-scribed and translated as two separate polypeptides, the N-intein and C-intein, each fused to one extein. Upon translation, the intein fragments spontaneously and non-covalently assemble into the canonical intein structure to carry out protein splicing in trans. The mechanism of protein splicing entails a series of acyl-transfer reactions that result in the cleavage of two peptide bonds at the intein-extein junctions and the formation of a new peptide bond between the N- and C-exteins. This process is initiated by activation of the peptide bond joining the N-extein and the N-terminus of the intein. Virtually all inteins have a cysteine or serine at their N-terminus that attacks the carbonyl carbon of the C-terminal N-extein residue. This N to O/S acyl-shift is facilitated by a conserved threonine and histidine (referred to as the TXXH motif), along with a commonly found aspartate, which results in the formation of a linear (thio) ester intermediate. Next, this intermediate is subject to trans-(thio)esterification by nucleophilic attack of the first C-extein residue (+1), which is a cysteine, serine, or threonine. The resulting branched (thio)ester intermediate is resolved through a unique transformation: cyclization of the highly conserved C-terminal asparagine of the intein. This process is facilitated by the histidine (found in a highly conserved HNF motif) and the penultimate histidine and may also involve the aspartate. This succinimide formation reaction excises the intein from the reactive complex and leaves behind the exteins attached through a non-peptidic linkage. This structure rapidly rearranges into a stable peptide bond in an intein-independent fashion.

In some embodiments, an N-terminal fragment of a base editor (e.g., ABE, CBE) is fused to a split intein-N and a C-terminal fragment is fused to a split intein-C. These fragments are then packaged into two or more AAV vectors. The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

In some embodiments, an ABE was split into N- and C-terminal fragments at Ala, Ser, Thr, or Cys residues within selected regions of SpCas9. These regions correspond to loop regions identified by Cas9 crystal structure analysis. The N-terminus of each fragment is fused to an intein-N and the C-terminus of each fragment is fused to an intein C at amino acid positions S303, T310, T313, S355, A456, S460, A463, T466, S469, T472, T474, C574, S577, A589, and S590, which are indicated in Bold Capitals in the sequence below.

```
  1 mdkkysigld igtnsvgwav itdeykvpsk kfkvlgntdr hsikknliga llfdsgetae 61 atrlkrtarr rytrrknric ylqeifsnem akvddsffhr leesflveed kkherhpifg 121 nivdevayhe kyptiyhlrk klvdstdkad lrliylalah mikfrghfli egdlnpdnsd 181 vdklfiqlvq tynqlfeenp inasgvdaka ilsarlsksr rlenliaqlp gekknglfgn 241 lialslgltp nfksnfdlae daklqlskdt ydddldnlla qigdqyadlf laaknlsdai 301 llSdilrvnT eiTkaplsas mikrydehhq dltllkalvr qqlpekykei ffdqSkngya
```

```
 361 gyidggasqe efykfikpil ekmdgteell vklnredllr kqrtfdngsi phqihlgelh 421 ailrrqedfy pflkdnreki ekiltfripy yvgplArgnS rfAwmTrkSe eTiTpwnfee 481 vvdkgasaqs fiermtnfdk nlpnekvlpk hsllyeyftv yneltkvkyv tegmrkpafl 541 sgeqkkaivd llfktnrkvt vkqlkedyfk kieCfdSvei sgvedrfnAS lgtyhdllki 601 ikdkdfldne enedilediv ltltlfedre mieerlktya hlfddkvmkq lkrrrytgwg 661 rlsrklingi rdkqsgktil dflksdgfan rnfmqlihdd sltfkediqk aqvsgqgdsl 721 hehianlags paikkgilqt vkvvdelvkv mgrhkpeniv iemarenqtt qkgqknsrer 781 mkrieegike lgsqilkehp ventqlqnek lylyylqngr dmyvdqeldi nrlsdydvdh 841 ivpqsflkdd sidnkvltrs dknrgksdnv pseevvkkmk nywrqllnak litqrkfdnl 901 tkaergglse ldkagfikrq lvetrqitkh vaqildsrmn tkydendkli revkvitlks 961 klvsdfrkdf qfykvreinn yhhandayln avvgtalikk ypklesefvy gdykvydvrk 1021 miakseqeig katakyffys nimnffktei tlangeirkr plietngetg eivwdkgrdf 1081 atvrkvlsmp qvnivkktev qtggfskesi lpkrnsdkli arkkdwdpkk yggfdsptva 1141 ysvlvvakve kgkskklksv kellgitime rssfeknpid fleakgykev kkdliiklpk 1201 yslfelengr krmlasagel qkgnelalps kyvnflylas hyeklkgspe dneqkqlfve 1261 qhkhyldeii eqisefskry iladanldkv lsaynkhrdk pireqaenii hlftltnlga 1321 paafkyfdtt idrkrytstk evldatlihq sitglyetri dlsqlggd
```

Use of Nucleobase Editors to Target Mutations

The suitability of nucleobase editors or multi-effector nucleobase editors that target one or more mutations is evaluated as described herein. In one embodiment, a single cell of interest is transduced with a base editing system together with a small amount of a vector encoding a reporter (e.g., GFP). These cells can be any cell line known in the art, including immortalized human cell lines, such as 293T, K562 or U20S. Alternatively, primary cells (e.g., human) may be used. Such cells may be relevant to the eventual cell target.

Delivery may be performed using a viral vector. In one embodiment, transfection may be performed using lipid transfection (such as Lipofectamine® transfection reagent or Fugene) or by electroporation. Following transfection, expression of GFP can be determined either by fluorescence microscopy or by flow cytometry to confirm consistent and high levels of transfection. These preliminary transfections can comprise different nucleobase editors to determine which combinations of editors give the greatest activity.

The activity of the nucleobase editor is assessed as described herein, i.e., by sequencing the genome of the cells to detect alterations in a target sequence. For Sanger sequencing, purified PCR amplicons are cloned into a plasmid backbone, transformed, miniprepped and sequenced with a single primer. Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq® next generation sequencing instrument).

The fusion proteins that induce the greatest levels of target specific alterations in initial tests can be selected for further evaluation.

In particular embodiments, the nucleobase editors or multi-effector base editors are used to target polynucleotides of interest. In one embodiment, a nucleobase editor or multi-effector base editor of the invention is delivered to cells (e.g., hematopoietic cells or their progenitors, hematopoietic stem cells, and/or induced pluripotent stem cells) in conjunction with a guide RNA that is used to target a mutation of interest within the genome of a cell, thereby altering the mutation. In some embodiments, a base editor is targeted by a guide RNA to introduce one or more edits to the sequence of a gene of interest.

In one embodiment, a nucleobase editor or multi-effector nucleobase editor is used to target a regulatory sequence, including but not limited to splice sites, enhancers, and transcriptional regulatory elements. The effect of the alteration on the expression of a gene controlled by the regulatory element is then assayed using any method known in the art.

In other embodiments, a nucleobase editor or multi-effector nucleobase editor of the invention is used to target a polynucleotide encoding a Complementarity Determining Region (CDR), thereby creating alterations in the expressed CDR. The effect of these alterations on CDR function is then assayed, for example, by measuring the specific binding of the CDR to its antigen.

In still other embodiments, a multi-effector nucleobase editor of the invention is used to target polynucleotides of interest within the genome of an organism. In one embodiment, a multi-effector nucleobase editor of the invention is delivered to cells in conjunction with a library of guide RNAs that are used to tile a variety of sequences within the genome of a cell, thereby systematically altering sequences throughout the genome.

The system can comprise one or more different vectors. In an aspect, the base editor is codon optimized for expression the desired cell type, preferentially a eukaryotic cell, preferably a mammalian cell or a human cell.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/ (visited Jul. 9, 2002), and these tables can be adapted in a number of ways. See, Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding an engineered nuclease correspond to the most frequently used codon for a particular amino acid.

Packaging cells are typically used to form virus particles that are capable of infecting a host cell. Such cells include 293 cells, which package adenovirus, and psi.2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA can be packaged in a cell line, which contains a helper plasmid encoding the other AAV genes, namely rep and cap, but lacking ITR sequences. The cell line can also be infected with adenovirus as a helper. The helper virus can promote replication of the AAV vector and expression of AAV genes from the helper plasmid. The helper plasmid in some cases is not packaged in significant amounts due to a lack of ITR sequences. Contamination with adenovirus can be reduced by, e.g., heat treatment to which adenovirus is more sensitive than AAV.

Applications for Multi-Effector Nucleobase Editors

The multi-effector nucleobase editors can be used to target polynucleotides of interest to create alterations that modify protein expression. In one embodiment, a multi-effector nucleobase editor is used to modify a non-coding or regulatory sequence, including but not limited to splice sites, enhancers, and transcriptional regulatory elements. The effect of the alteration on the expression of a gene controlled by the regulatory element is then assayed using any method known in the art. In a particular embodiment, a multi-effector nucleobase editor is able to substantially alter a regulatory sequence, thereby abolishing its ability to regulate gene expression. Advantageously, this can be done without generating double-stranded breaks in the genomic target sequence, in contrast to other RNA-programmable nucleases.

The multi-effector nucleobase editors can be used to target polynucleotides of interest to create alterations that modify protein activity. In the context of mutagenesis, for example, multi-effector nucleobase editors have a number of advantages over error-prone PCR and other polymerase-based methods. Because multi-effector nucleobase editors of the invention create alterations at multiple bases in a target region, such mutations are more likely to be expressed at the protein level relative to mutations introduced by error-prone PCR, which are less likely to be expressed at the protein level given that a single nucleotide change in a codon may still encode the same amino acid (e.g., codon degeneracy). Unlike error-prone PCR, which induces random alterations throughout a polynucleotide, multi-effector nucleobase editors of the invention can be used to target specific amino acids within a small or defined region of a protein of interest.

In other embodiments, a multi-effector nucleobase editor of the invention is used to target a polynucleotide of interest within the genome of an organism. In one embodiment, the organism is a bacteria of the microbiome (e.g., *Bacteriodetes, Verrucomicrobia, Firmicutes; Gammaproteobacteria, Alphaproteobacteria, Bacteriodetes, Clostridia, Erysipelotrichia, Bacilli; Enterobacteriales, Bacteriodales, Verrucomicrobiales, Clostridiales, Erysiopelotrichales, Lactobacillales; Enterobacteriaceae, Bacteroidaceae, Erysiopelotrichaceae, Prevotellaceae, Coriobacteriaceae, and Alcaligenaceae, Escherichia, Bacteroides, Alistipes, Akkermansia, Clostridium, Lactobacillus*). In another embodiment, the organism is an agriculturally important animal (e.g., cow, sheep, goat, horse, chicken, turkey) or plant (e.g., soybeans, wheat, corn, rice, tobacco, apples, grapes, peaches, plums, cherries). In one embodiment, a multi-effector nucleobase editor of the invention is delivered to cells in conjunction with a library of guide RNAs that are used to tile a variety of sequences within the genome of a cell, thereby systematically altering sequences throughout the genome.

Mutations may be made in any of a variety of proteins to facilitate structure function analysis or to alter the endogenous activity of the protein. Mutations may be made, for example, in an enzyme (e.g., kinase, phosphatase, carboxylase, phosphodiesterase) or in an enzyme substrate, in a receptor or in its ligand, and in an antibody and its antigen. In one embodiment, a multi-effector nucleobase editor targets a nucleic acid molecule encoding the active site of the enzyme, the ligand binding site of a receptor, or a complementarity determining region (CDR) of an antibody. In the case of an enzyme, inducing mutations in the active site could increase, decrease, or abolish the enzyme's activity. The effect of mutations on the enzyme is characterized in an enzyme activity assay, including any of a number of assays known in the art and/or that would be apparent to the skilled artisan. In the case of a receptor, mutations made at the ligand binding site could increase, decrease or abolish the receptors affinity for its ligand. The effect of such mutations is assayed in a receptor/ligand binding assay, including any of a number of assays known in the art and/or that would be apparent to the skilled artisan. In the case of a CDR, mutations made within the CDR could increase, decrease or abolish binding to the antigen. Alternatively, mutations made within the CDR could alter the specificity of the antibody for the antigen. The effect of these alterations on CDR function is then assayed, for example, by measuring the specific binding of the CDR to its antigen or in any other type of immunoassay.

Pharmaceutical Compositions

Other aspects of the present disclosure relate to pharmaceutical compositions comprising any of the base editors, fusion proteins, or the fusion protein-guide polynucleotide complexes described herein. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

Suitable pharmaceutically acceptable carriers generally comprise inert substances that aid in administering the pharmaceutical composition to a subject, aid in processing the pharmaceutical compositions into deliverable preparations, or aid in storing the pharmaceutical composition prior to administration. Pharmaceutically acceptable carriers can include agents that can stabilize, optimize or otherwise alter the form, consistency, viscosity, pH, pharmacokinetics, solubility of the formulation.

Some nonlimiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Buffering agents, wetting agents, emulsifying agents, diluents, encapsulating agents, skin penetration enhancers, coloring agents, release agents, coating agents, sweetening agents, flavoring agents, perfuming agents, preservative and antioxidants can also be present in the formulation. For example, carriers can include, but are not limited to, saline, buffered saline, dextrose, arginine, sucrose, water, glycerol, ethanol, sorbitol, dextran, sodium carboxymethyl cellulose, and combinations thereof.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g., tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In some embodiments, the pharmaceutical composition is formulated for delivery to a subject, e.g., for gene editing. In some embodiments, administration of the pharmaceutical compositions contemplated herein may be carried out using conventional techniques including, but not limited to, infusion, transfusion, or parenterally. In some embodiments, parenteral administration includes infusing or injecting intravascularly, intravenously, intramuscularly, intraarterially, intrathecally, intratumorally, intradermally, intraperitoneally, transtracheally, subcutaneously, subcuticularly, intraarticularly, subcapsularly, subarachnoidly and intrasternally. In some embodiments, suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (see, e.g., Langer, 1990, Science 249: 1527-1533; Sefton, 1989, CRC Crit. Ref Biomed. Eng. 14:201; Buchwald et al., 1980, Surgery 88:507; Saudek et al, 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228: 190; During et al., 1989, Ann. Neurol. 25:351; Howard et ah, 1989, J. Neurosurg. 71: 105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et ah, Gene Ther. 1999, 6: 1438-47). Positively charged lipids such as N-[1-(2,3-dioleoyloxi)propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers can be formed from a variety of materials such as glass or plastic. In some embodiments, the container holds a composition that is effective for treating a disease described herein and can have a sterile access port. For example, the container can be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture can further comprise a second container comprising a pharmaceutically-acceptable buffer, such as phosphate-buffered saline, Ringer's solution, or dextrose solution. It can further include other materials desirable from a commercial and user standpoint, including other buffers, diluents, filters, needles, syringes, and package inserts with instructions for use.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts, for example, for veterinary use.

Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein can be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit. Pharmaceutical formulations can additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131 (Publication number WO2011/053982 A8, filed Nov. 2, 2010), incorporated in its entirety herein by reference, for additional suitable methods, reagents, excipients and solvents for producing pharmaceutical compositions comprising a nuclease.

Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

The compositions, as described above, can be administered in effective amounts. The effective amount will depend upon the mode of administration, the particular condition being treated, and the desired outcome. It may also depend upon the stage of the condition, the age and physical condition of the subject, the nature of concurrent therapy, if any, and like factors well-known to the medical practitioner. For therapeutic applications, it is that amount sufficient to achieve a medically desirable result.

In some embodiments, compositions in accordance with the present disclosure can be used for treatment of any of a variety of diseases, disorders, and/or conditions.

Kits, Vectors, Cells

Various aspects of this disclosure provide kits comprising abase editor system. In one embodiment, the kit comprises a nucleic acid construct comprising a nucleotide sequence encoding a nucleobase editor fusion protein. The fusion protein comprises one or more deaminase domains (e.g., cytidine deaminase and/or adenine deaminase) and a nucleic acid programmable DNA binding protein (napDNAbp). In some embodiments, the kit comprises at least one guide RNA capable of targeting a nucleic acid molecule of interest. In some embodiments, the kit comprises a nucleic acid construct comprising a nucleotide sequence encoding at least one guide RNA. In some embodiments, the kit comprises a nucleic acid construct, comprising a nucleotide sequence encoding (a) a Cas9 domain fused to an adenosine deaminase and/or a cytidine deaminase as provided herein; and (b) a heterologous promoter that drives expression of the sequence of (a).

The kit provides, in some embodiments, instructions for using the kit to edit one or more mutations. The instructions will generally include information about the use of the kit for editing nucleic acid molecules. In other embodiments, the instructions include at least one of the following: precautions; warnings; clinical studies; and/or references. The instructions may be printed directly on the container (when present), or as a label applied to the container, or as a separate sheet, pamphlet, card, or folder supplied in or with the container. In a further embodiment, a kit can comprise instructions in the form of a label or separate insert (package insert) for suitable operational parameters. In yet another embodiment, the kit can comprise one or more containers with appropriate positive and negative controls or control samples, to be used as standard(s) for detection, calibration, or normalization. The kit can further comprise a second container comprising a pharmaceutically-acceptable buffer, such as (sterile) phosphate-buffered saline, Ringer's solution, or dextrose solution. It can further include other materials desirable from a commercial and user standpoint, including other buffers, diluents, filters, needles, syringes, and package inserts with instructions for use.

Some aspects of this disclosure provide cells comprising any of the nucleobase editors or multi-effector nucleobase editors or fusion proteins provided herein. In some embodiments, the cells comprise any of the nucleotides or vectors provided herein.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Figure 2:
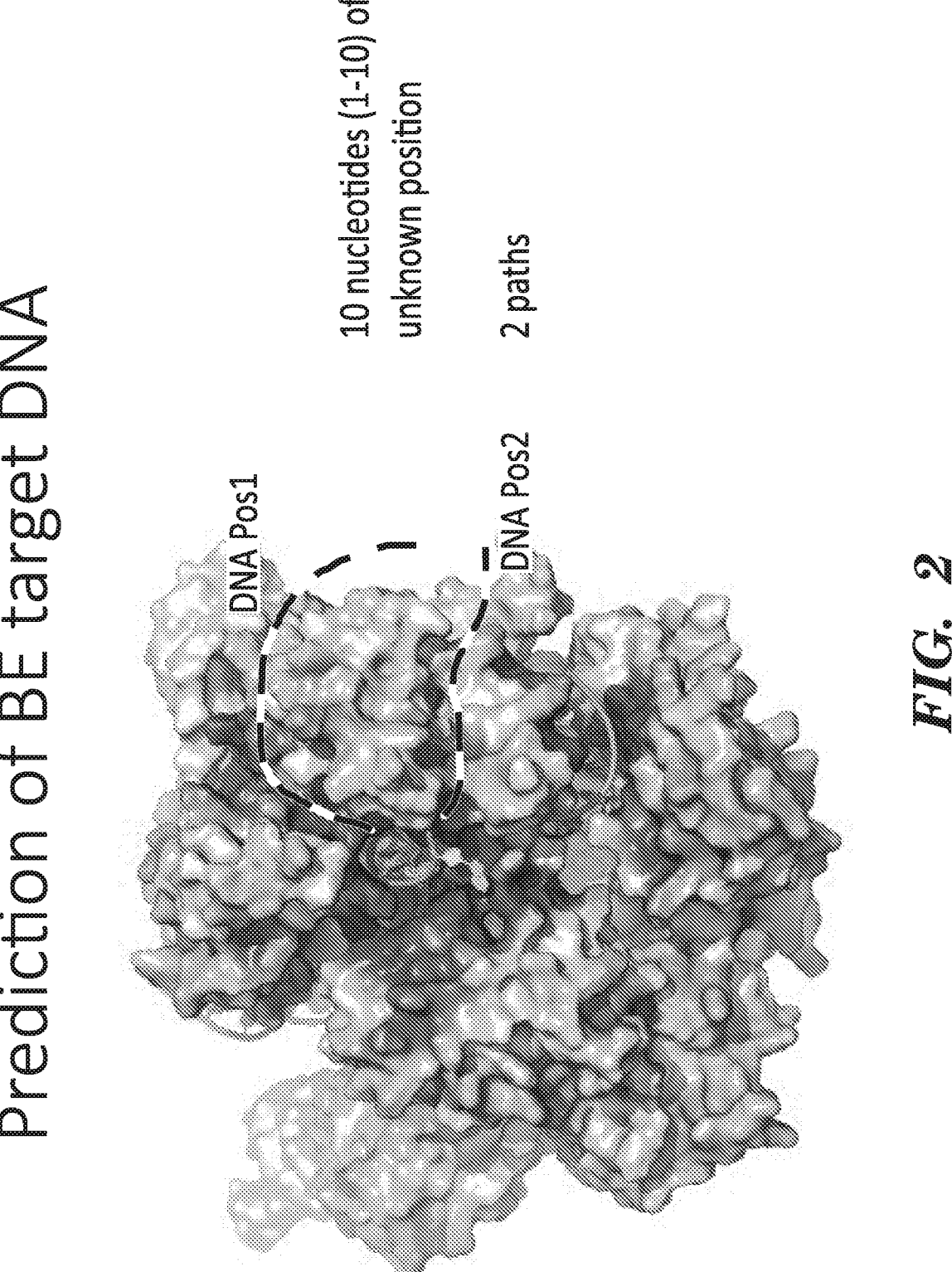
FIG. 2 is a model depicting prediction of the location of target DNA for base editing.
Figure 3:
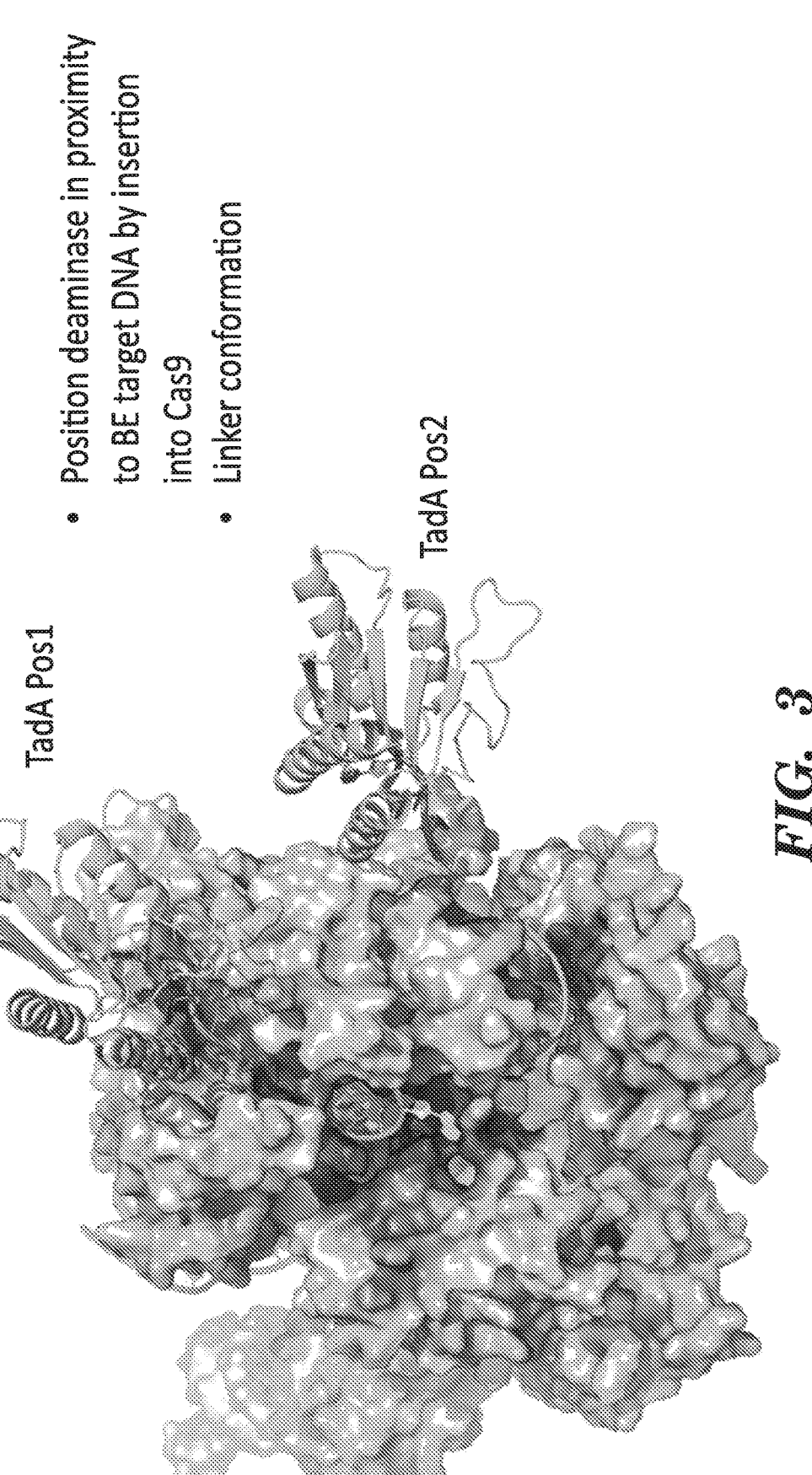
FIG. 3 depicts a model showing positions of a deaminase domain in proximity to the locations of target DNA in FIG. 2.
Figure 4:
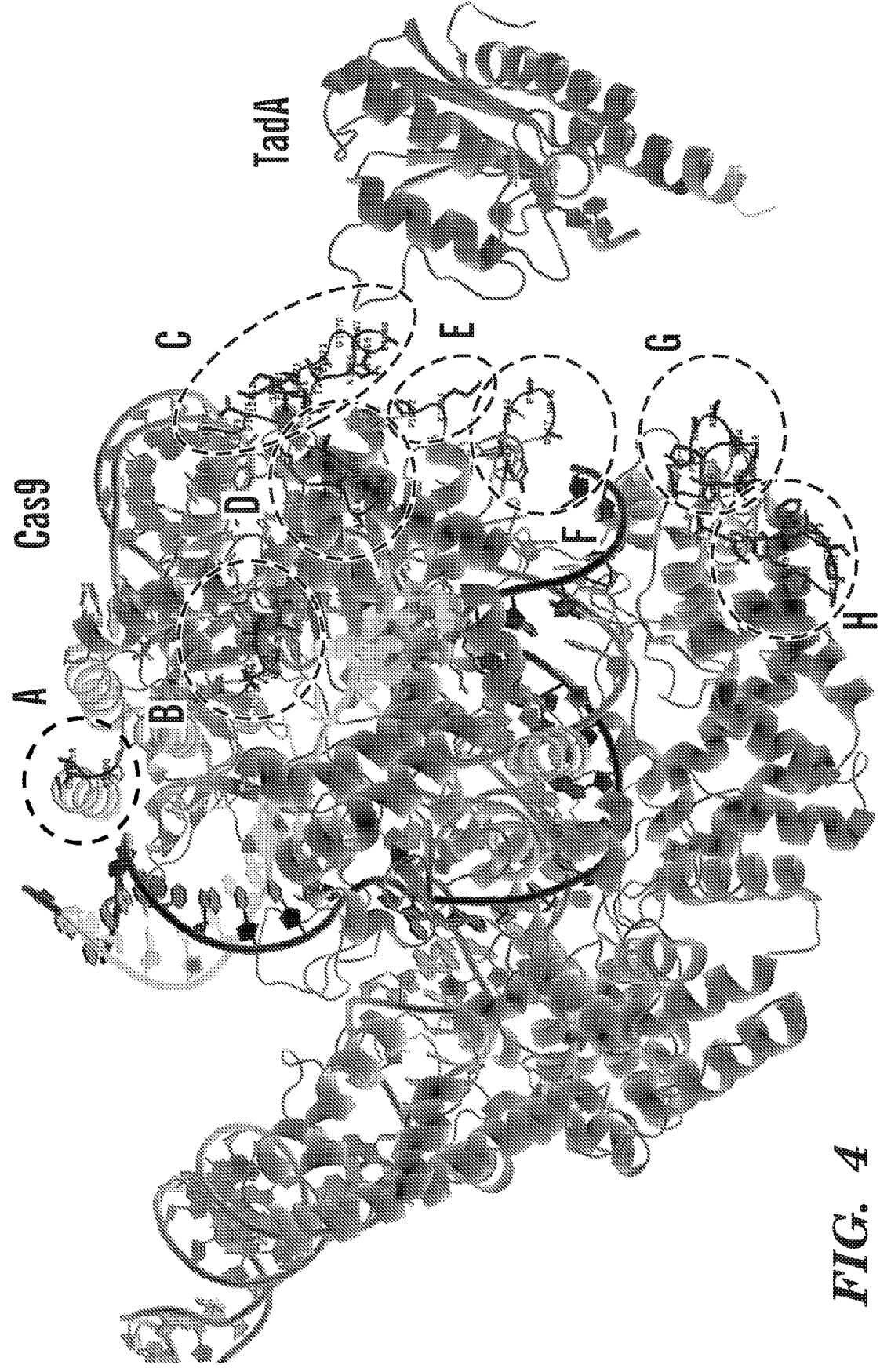
FIG. 4 is a model of an adenosine nucleobase editor depicting regions identified where one or more deaminase domains may be inserted into Cas9. Loops (yellow) that are in proximity to where a deaminase domain may target single stranded DNA (magenta). Regions of interest include those marked A, B, C, D, E, F, G, and H.
Figure 5:
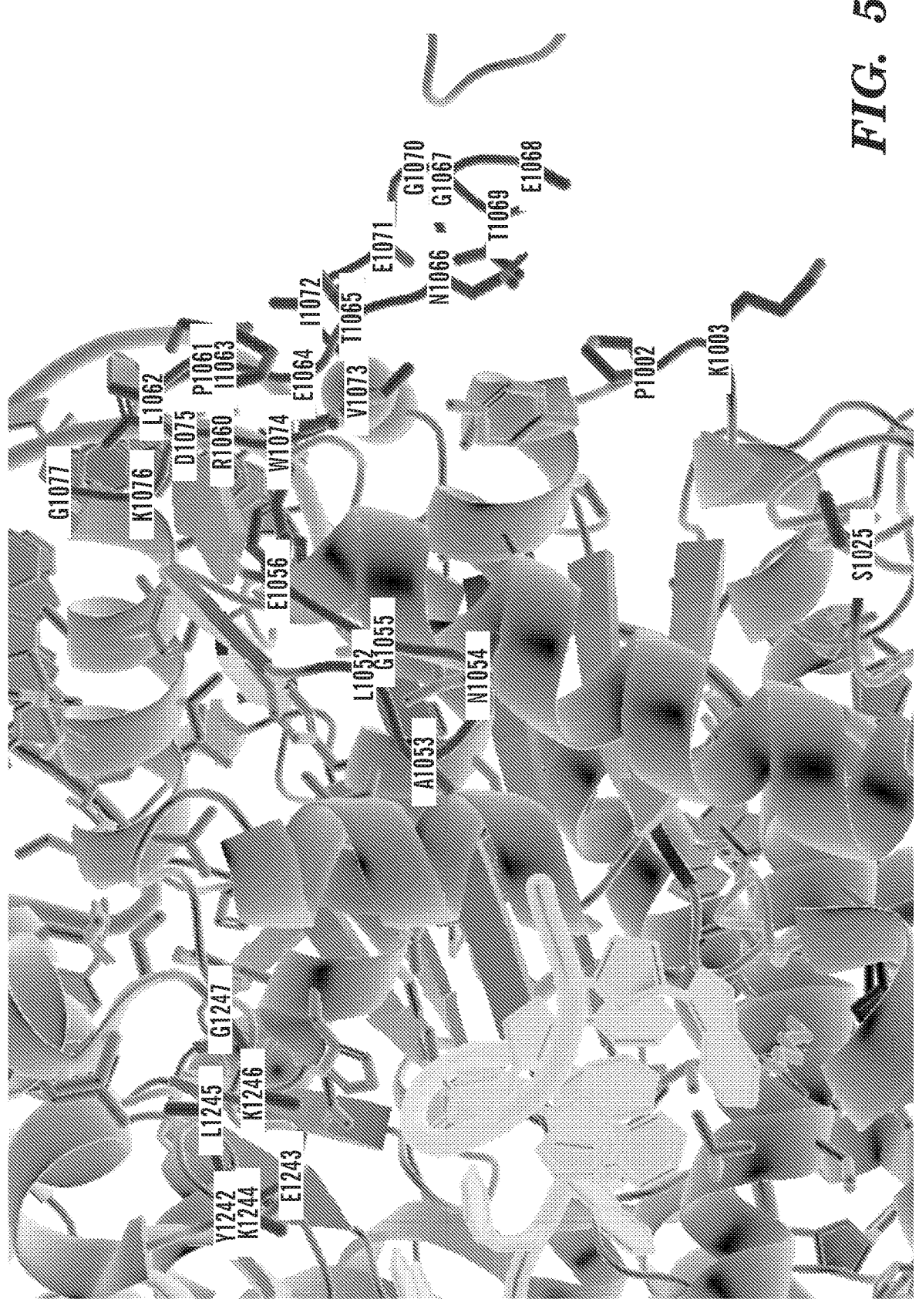
FIG. 5 is a magnified view of the model in FIG. 4, showing residues in regions B, C, D, E, and F.
Figure 6:
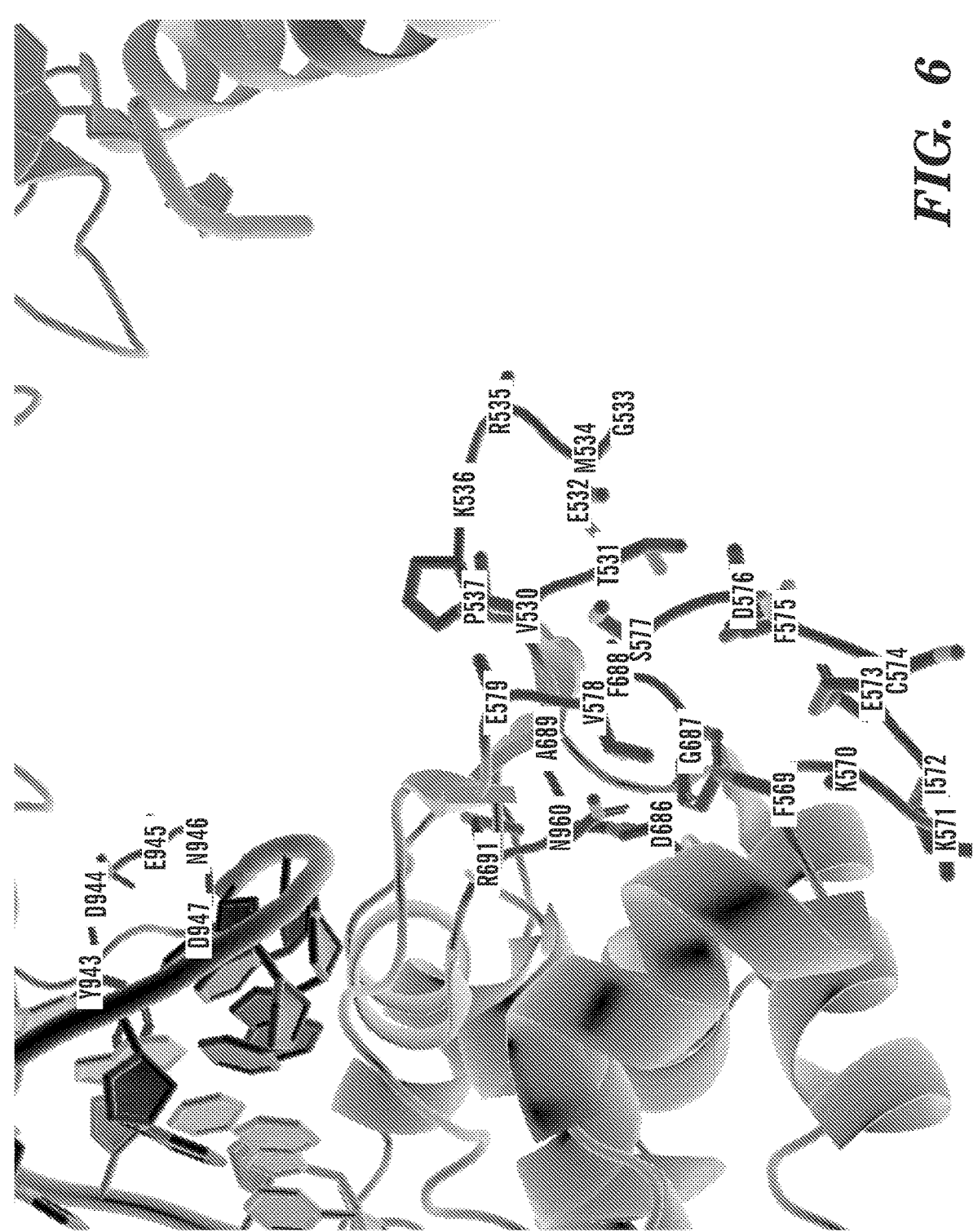
FIG. 6 is a magnified view of the model in FIG. 4, showing residues in regions F, G, and H.
Figure 7:
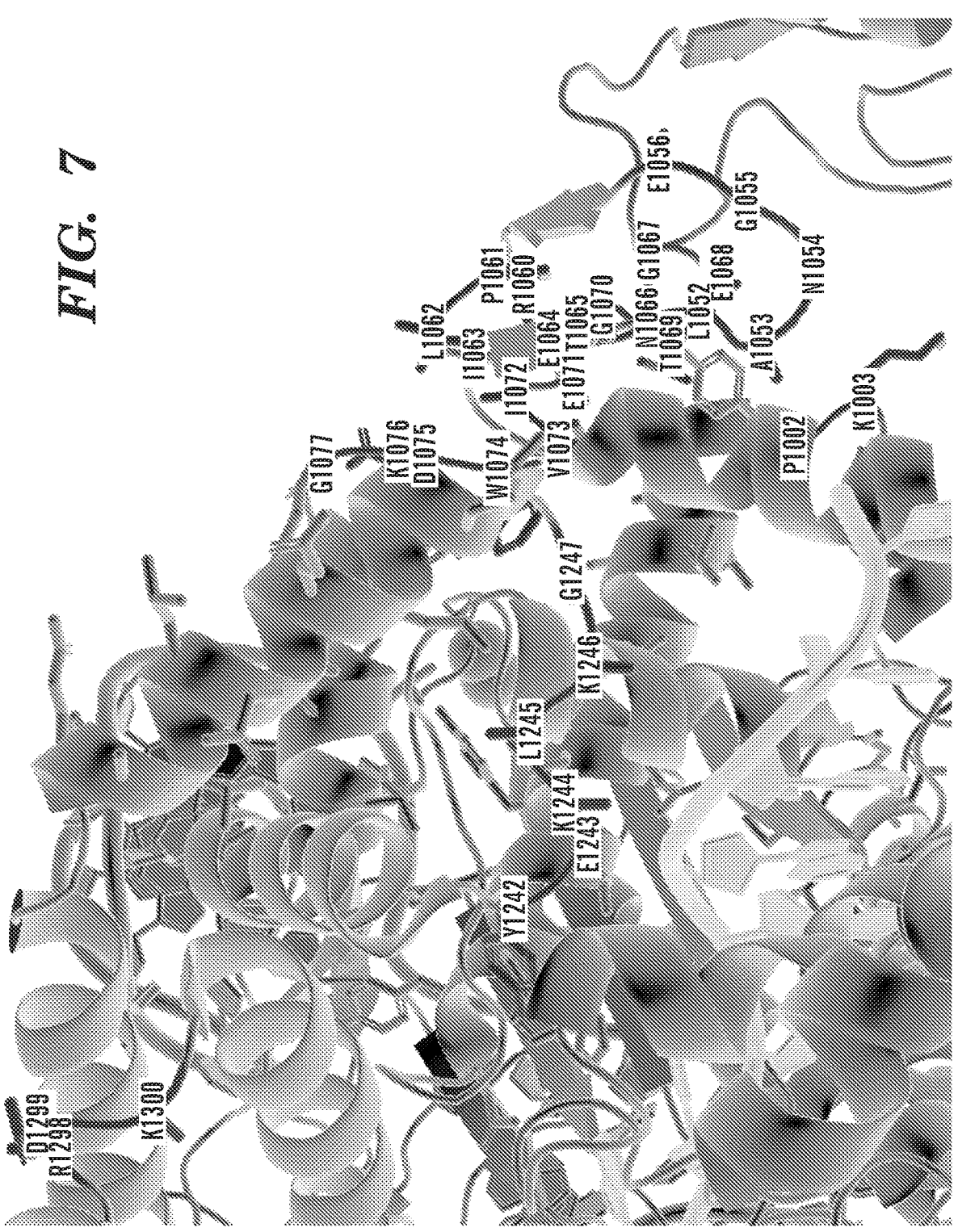
FIG. 7 is a magnified view of the model in FIG. 4, showing residues in regions A, B, C, D, and E.

Example 1: Construction of Nucleobase Editors Having Reduced Non-Target Deamination Nucleobase editors (e.g., fusion proteins of a CRISPR-Cas protein and a deaminase joined by a linker) can be used to introduce specific point mutations into target polynucleotides. However, nucleobase editors carry with them the potential for unintended genome-wide spurious deamination, bystander mutation, and target proximal edits. Without being bound by theory, shortening or removing the linker from base editors would reduce the potential for unintended deamination events and/or promote desired target deamination (FIG. 1). This may be due in part to reducing the effective radius of activity for the deaminase domain of the nucleobase editor. Although the structure of Cas9 bound to DNA has been determined by X-ray crystallography, no structural information exist for the portion of DNA where base editing occurs. Modeling of Cas9 predicts that the DNA where base editing occurs could be at 2 positions in proximity to Cas9 (FIG. 2). Based on these predictions, positioning a deaminase or fragment thereof at one or more of these positions has the potential to promote on-target base editing while reducing undesired deamination events (FIG. 3). Several regions were identified in the adenosine base editor (e.g., Cas9 fused to TadA) that were amenable to insertion of the TadA deaminase or fragment thereof (FIGS. 4-7). Accordingly, adenosine deaminase base editors were generated to insert TadA or variants thereof into the Cas9 polypeptide at the identified positions.

Figure 8:
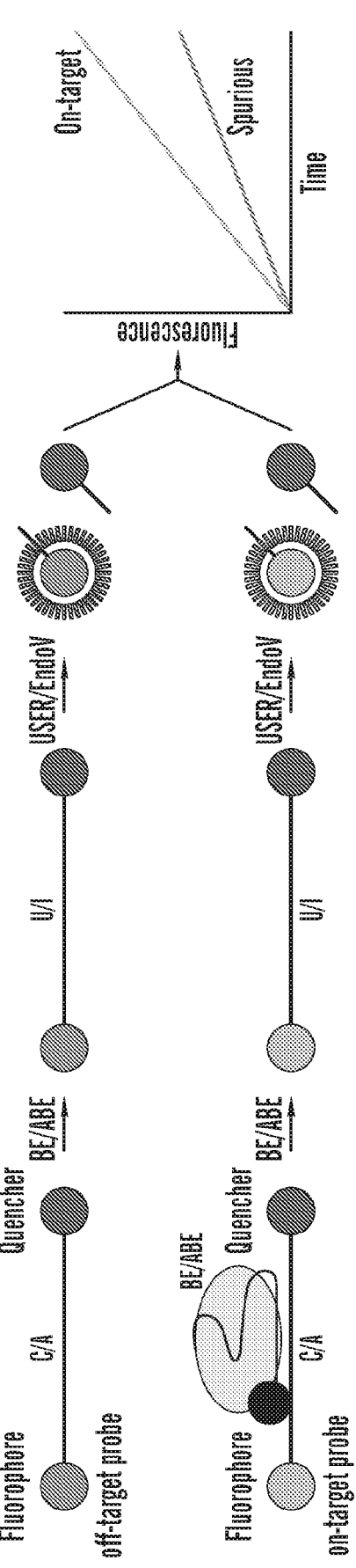
FIG. 8 depicts a high-throughput in vitro deamination assay. Spurious deamination of the probe can be distinguished from on-target deamination by comparing reactions containing nucleobase editor with an on-target probe containing a substrate for the base editor and a reaction in the absence of the base editor containing a probe for detecting off-target deamination.

Example 2: High-Throughput In Vitro Assays for Measuring On-Target and Off-Target Deamination An in vitro assay was developed to assess nucleobase editors and for characterizing candidate constructs that measures on-target deamination vs. non-target deamination, including spurious deamination. A FRET-based version of the assay uses a fluorescent reporter for detection, although the assay can be adapted for gel-based readout (FIG. 8). Probes for the in vitro deamination assay include substrates for deamination, and in particular substrates for nucleobase editors (FIG. 8). In addition to containing a nucleotide that can be deaminated, probes may include PAM sequences, target specific sequences, and the like, or even random sequences. Deamination reactions using sets of probes can be performed in parallel (e.g., high throughput format). Deamination of the substrate (C→U or A→I) renders the substrate cleavable by a deamination specific endonuclease (USER/EndonucleaseV, respectively) (FIG. 8). Cleavage of the substrate uncouples the fluorescent reporter from the quencher molecule, thereby generating a fluorescent signal (FIG. 8). A high on-target to off-target fluorescence ratio for indicates that a base editor is effect. Any interacting fluorophore and quencher pair or FRET donor-acceptor pair known in the art can be used. In certain embodiments, the fluorophore is one or more or FAM, TET, HEX, TAMRA, JOE, or ROX.

In various embodiments, the quencher is one or more of dabcyl, dabsyl, a Black Hole Quencher dye, including 5'Iowa Black® RQ (5IabRQ). In general, the quenching dye is an excitation matched quenching dye. Fluorophore-quencher pairs and their selection are described for example in Marras, Selection of Fluorophore and Quencher Pairs for Fluorescent Nucleic Acid Hybridization Probes in Methods in Molecular Biology: Fluorescent Energy Transfer Nucleic Acid Probes: Designs and Protocols. Edited by: V.V. Didenko© Humana Press Inc., Totowa, NJ.

Figure 9:
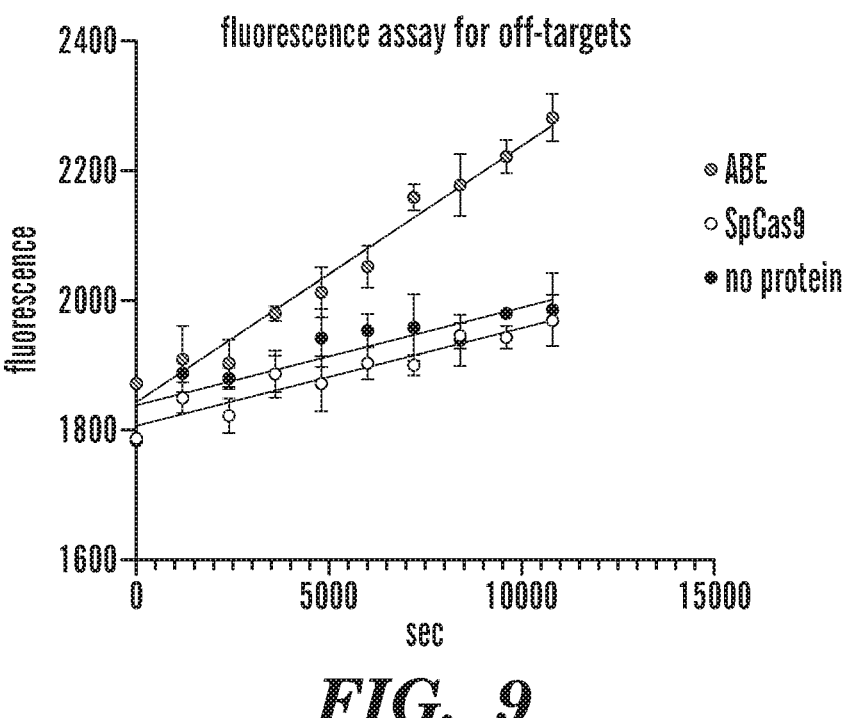
FIG. 9 is a graph depicting results of a fluorescence assay for off-target deamination.
Figure 10:
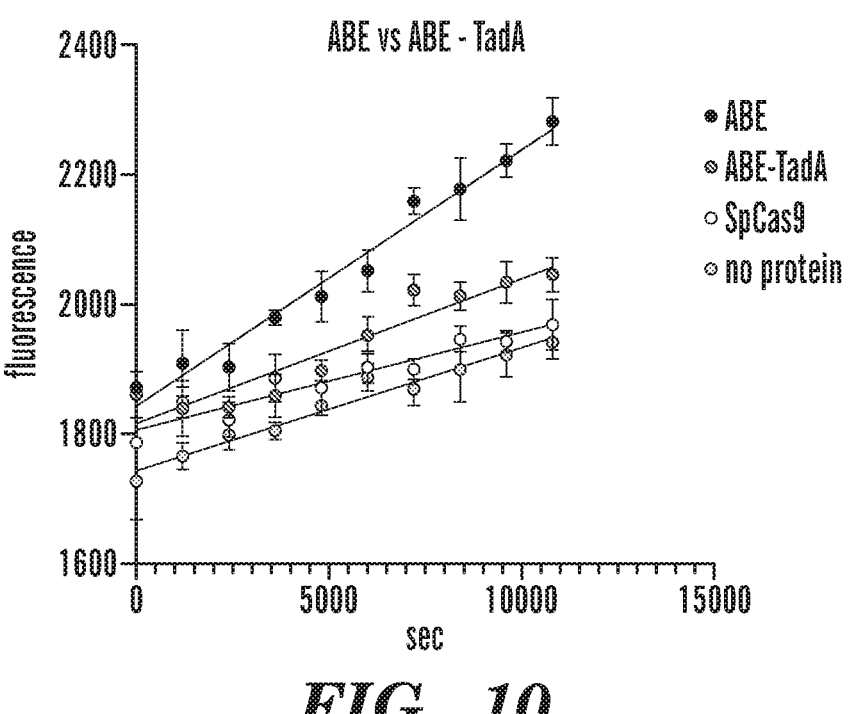
FIG. 10 is a graph depicting a comparison of adenosine base editor (ABE) v. an ABE system with TadA in trans.

As a demonstration of the assay, an adenosine base editor was assayed for the potential to generate off-target deamination by comparing the on-target deamination of the adenosine base editor to deamination occurring in the presence of SpCas9 (no deamination domain) or no protein (FIG. 9). The adenosine base editor reaction generated fluorescent signal above that of SpCas9 and no protein reactions, indicating that ABE was effective at on-target base editing. In another example, adenosine base editor was compared to an adenosine base editing in trans (ABE-TadA) where SpCas9 is present with TadA in trans (FIG. 10). ABE generated increased fluorescence compared to ABE-TadA, SpCas9, and no protein reaction and was effective at on-target base editing. Potential substrates for spurious off-target base editing can be tested in this assay, including single-stranded structures and branched structures, which may reflect other structures in the genome (e.g., DNA "breathing," replication forks, transcriptional active DNA, etc.) (FIG. 11).

Example 3: Assays to Evaluate the Activities of Deaminases in Cis and in Trans

Figure 12:
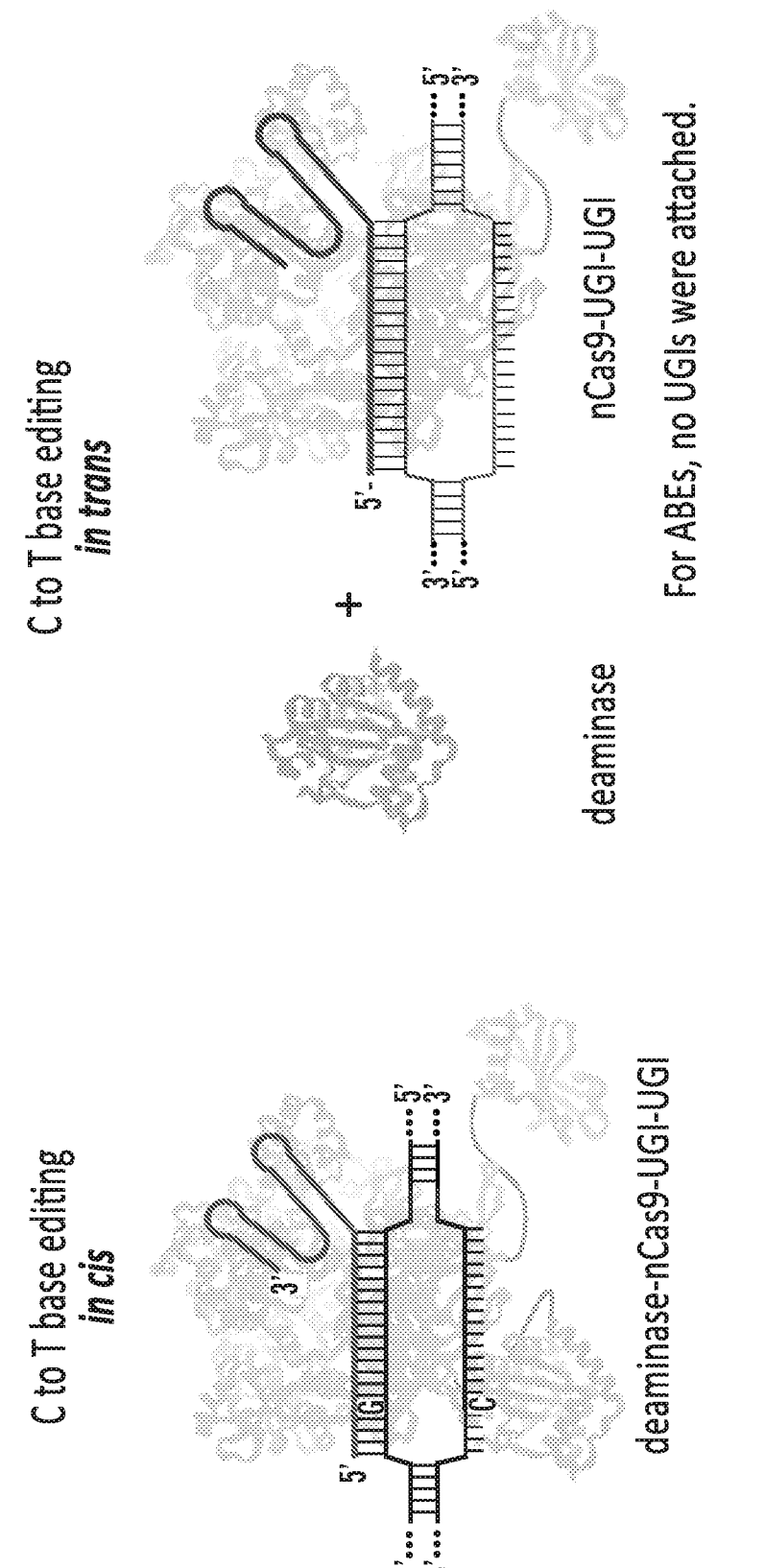
FIG. 12 depicts an assay to evaluate the activities of deaminases in cis and in trans.

An assay was developed to distinguish between the activities of deaminases in cis (deamination domain covalently bound to CRISPR-Cas) and in trans (CRISPR-Cas protein with deamination domain provided in trans) (FIG. 12). Deamination occurring in cis indicates deamination by targeted base editing whereas deamination in trans indicates spurious deamination. A high ratio of in cis to in trans activity indicates that a deaminase has reduced spurious deamination is effective as a base editor.

Figure 14:
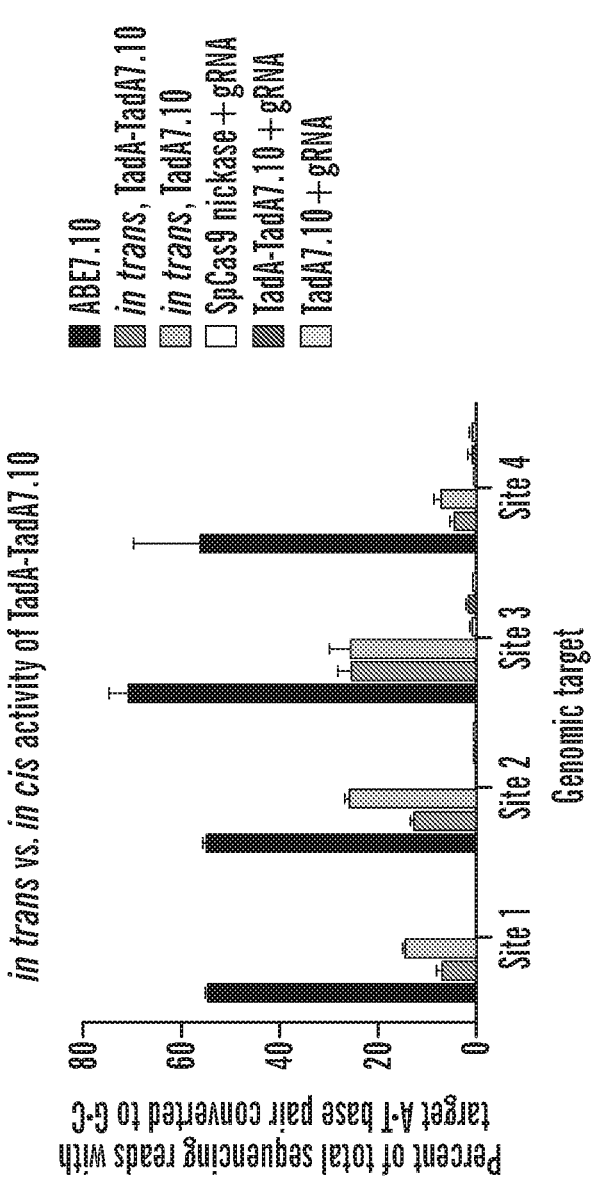
FIG. 14 is a graph depicting the activities of TadA-TadA7.10 in the in cis-in trans assay.
Figure 15:
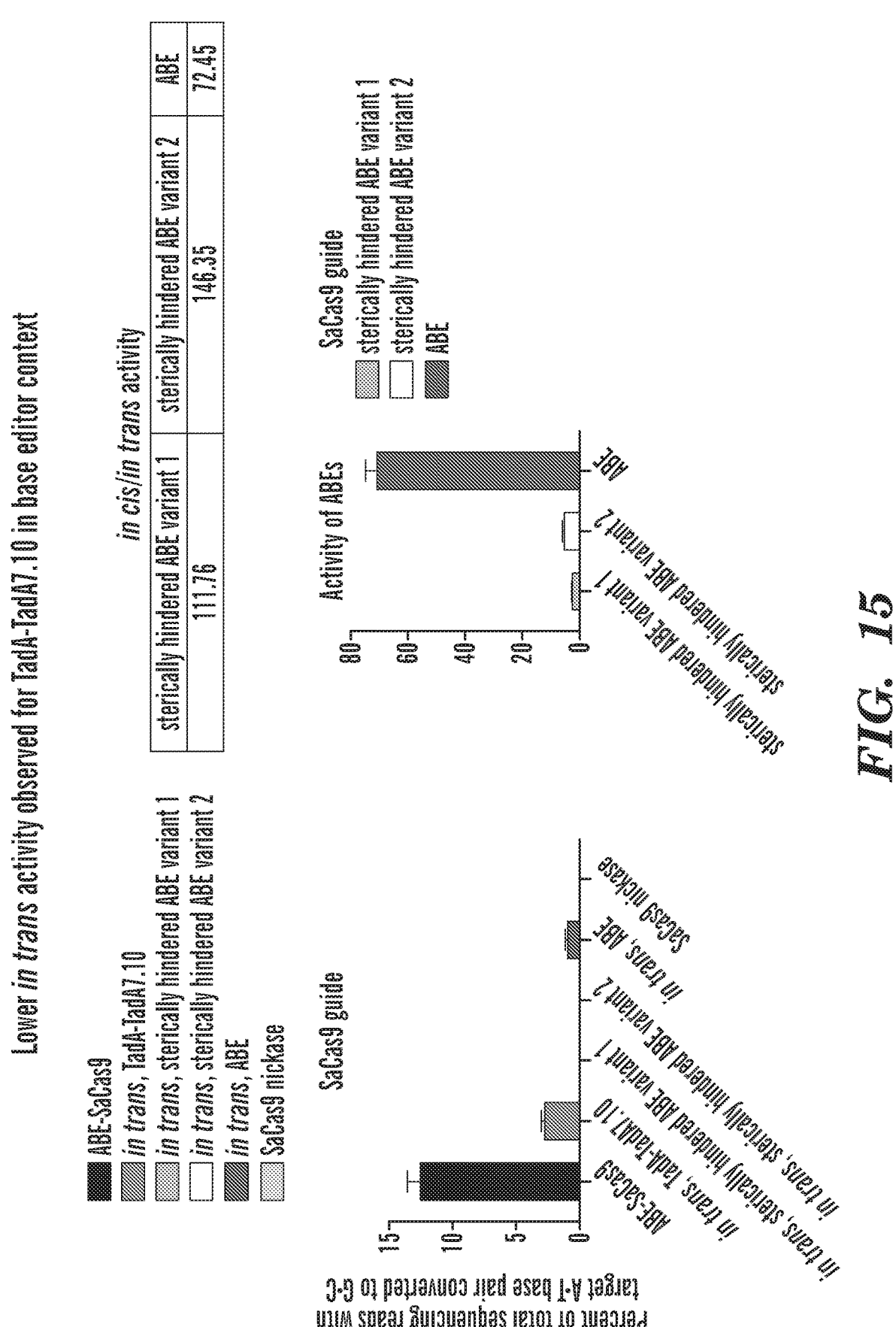
FIG. 15 depicts that lower in trans activity was observed for TadA-TadA7.10 in base editor context (in trans ABE).
Figure 16:
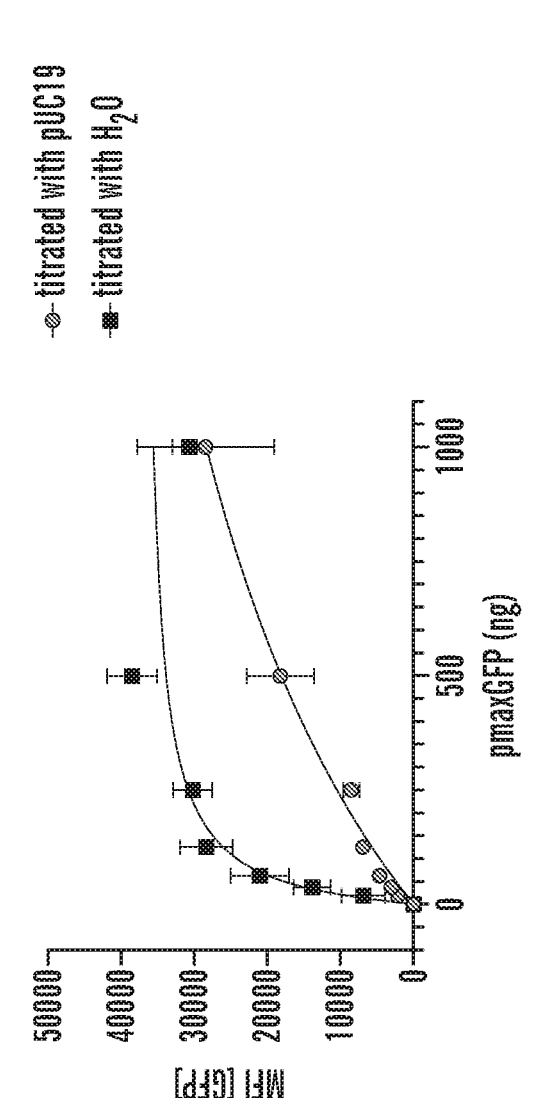
FIG. 16 is a graph depicting the results of dose-response for expression of GFP. Titration of pmaxGFP plasmid with empty vector resulted in decreased expression level of GFP.
Figure 17:
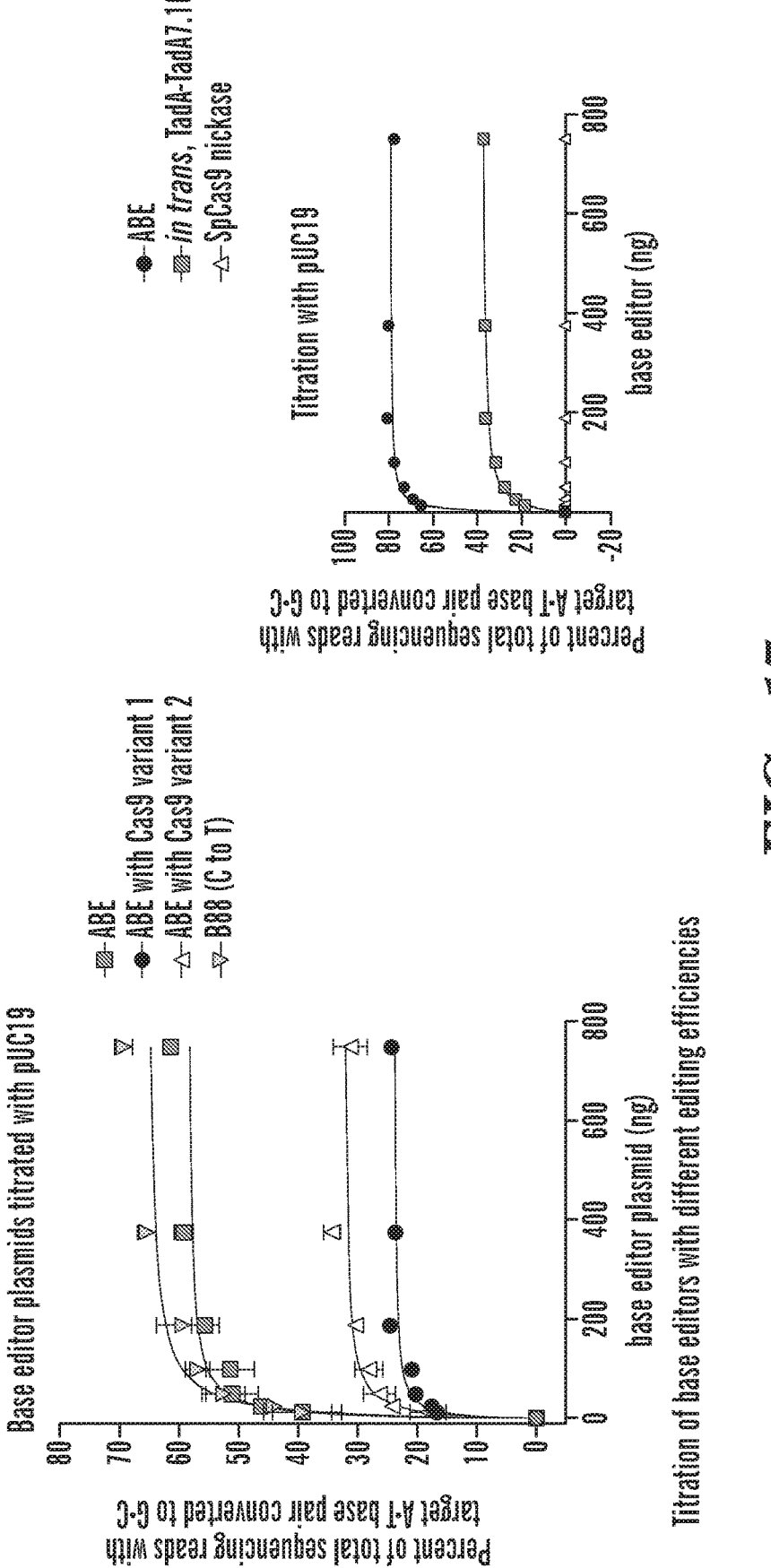
FIG. 17 is a graph depicting dose-response for in-cis and in-trans activities of adenosine nucleobase editor ABE.
Figure 19:
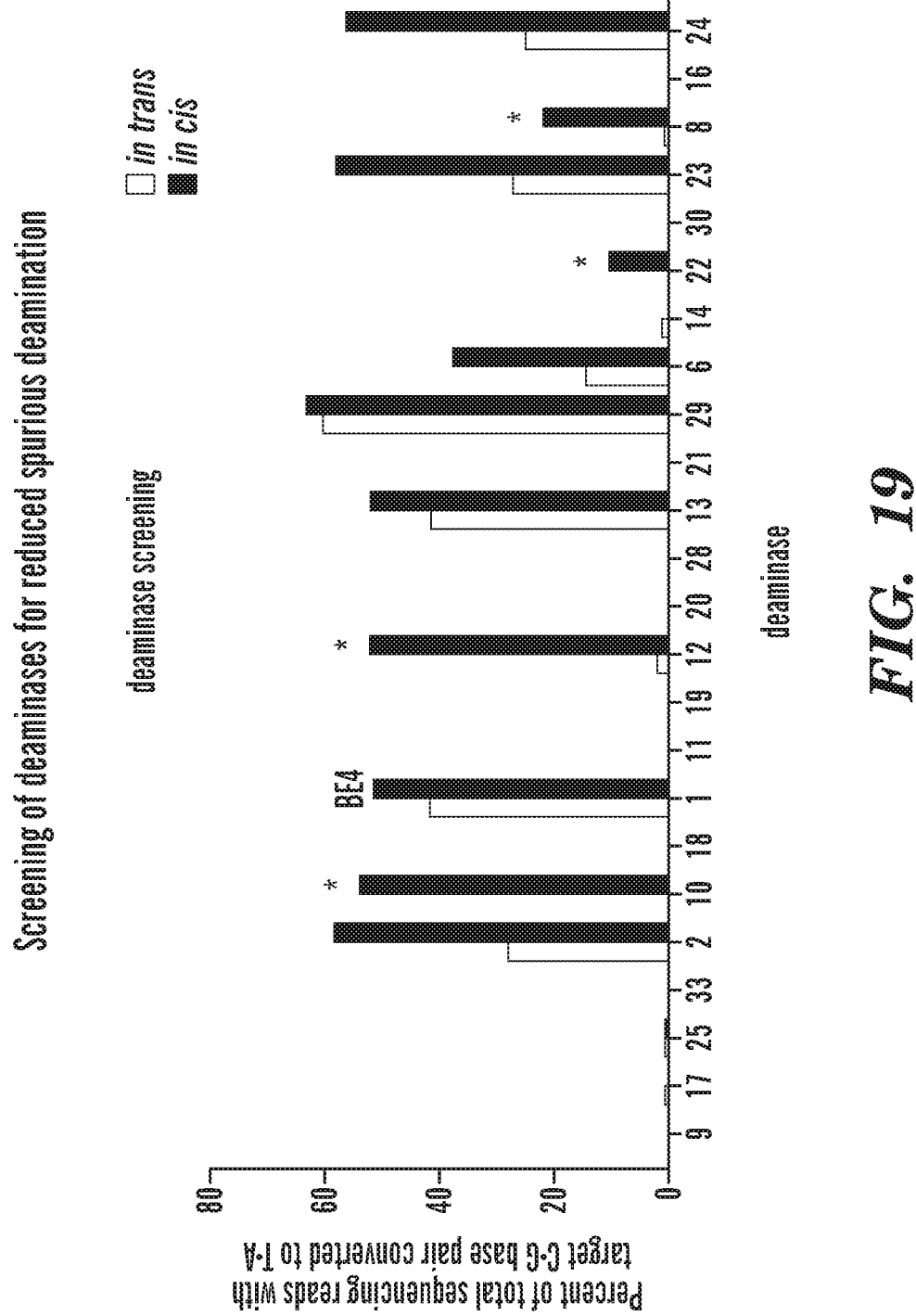
FIG. 19 is a graph showing the results of screening of deaminases for reduced spurious deamination. The deaminases ppAPOBEC-2 (10), mAPOBEC-2 (8), mAPOBEC-3 (12), and mfAPOBEC-4 (22) showed high in cis in trans activity.

Rat APOBEC1 was tested in the in cis-in trans assay. Briefly, HEK293T cells were transfected with construct expressing the base editor BE4 (rAPOBEC1-nCas9-UGI-UGI), rAPOBEC1 and nCas9, nCas9 and a guide RNA, or rAPOBEC1 and guide RNA. Genomic DNA was isolated from the cells and sequencing was obtained for 4 genomic target sites. At all sites, rAPOBEC1 showed higher in cis deaminase activity, compared to in trans deaminase activity, as well as the other control reactions lacking at least one of the components for targeted base editing (FIG. 13). Likewise, TadA7.10 also showed higher in cis deaminase activity, compared to in trans deaminase activity and other deamination events (FIG. 14). To understand the effect of the adenosine base editor in trans separate from the guide, an SaCas9-ABE and SaCas9 guide were tested in combination with SpCas9-ABE and an SaCas9 guide, and sterically hindered ABE variants and SaCas9 guides (FIG. 15). In this context, SpCas9-ABE showed lower in trans activity for TadA-TadA7.10 in base editor context. The ratio of in cis in trans activity for ABE and sterically hindered ABE variants was estimated using the in trans measurements from the SaCas9 guide assay and the activity of ABE and sterically hindered ABE variants. The estimated ratios for ABE and sterically hindered ABE variants was relatively high. Dose response studies for in cis and in trans activities were also conducted to determine if high in cis to in trans activity could be modulated by dose (e.g., where in cis activity increases more quickly that in trans activity with increasing dose). Under the conditions tested, a dose response of in cis to in trans activity was not observed (FIGS. 16-18).

The in cis-in trans assay was used to evaluate a variety of deaminases for reduced spurious deamination listed in Table 9 below:

TABLE 9

| Deaminases Screened using in cis-in trans assay | |
| --- | --- |
| 1 | rAPOBEC-1 |
| 2 | mAPOBEC-1 |
| 3 | maAPOBEC-1 |
| 4 | hAPOBEC-1 |
| 5 | ppAPOBEC-1 |
| 6 | ocAPOBEC1 |
| 7 | mdAPOBEC-1 |
| 8 | mAPOBEC-2 |
| 9 | hAPOBEC-2 |
| 10 | ppAPOBEC-2 |
| 11 | btAPOBEC-2 |
| 12 | mAPOBEC-3 |
| 13 | hAPOBEC-3A |

TABLE 9 -continued

| Deaminases Screened using in cis-in trans assay | |
| --- | --- |
| 14 | hAPOBEC-3B |
| 15 | hAPOBEC-3C |
| 16 | hAPOBEC-3D |
| 17 | hAPOBEC-3F |
| 18 | hAPOBEC-3G |
| 19 | hAPOBEC-4 |
| 20 | mAPOBEC-4 |
| 21 | rAPOBEC-4 |
| 22 | mfAPOBEC-4 |
| 23 | hAID |
| 24 | clAID |
| 25 | btAID |
| 26 | mAID |
| 27 | pmCDA-1 |
| 28 | pmCDA-2 |
| 29 | pmCDA-5 |
| 30 | yCD |
| 31 | rAPOBEC-1-delta 177-186 |
| 32 | rAPOBEC-1-delta 202-213 |

Interestingly, several deaminases showed high in cis/in trans activity, including ppAPOBEC-2, mAPOBEC-2, mAPOBEC-3, and mfAPOBEC-4.

rAPOBEC-1 *Rattus norvegicus*
MSSETGPVAVDPTLRRRIEPHEFEVFFDPRELRKE
TCLLYEINWGGRHSIWRHTSQNTNKHVEVNFIEKF
TTERYFCPNTRCSITWFLSWSPCGECSRAITEFLS
RYPHVTLFIYIARLYHHADPRNRQGLRDLISSGVT
IQIMTEQESGYCWRNFVNYSPSNEAHWPRYPHLWV
RLYVLELYCIILGLPPCLNILRRKQPQLTFFTIAL
QSCHYQRLPPHILWATGLK mAPOBEC-1 *Mus musculus*
MSSETGPVAVDPTLRRRIEPHEFEVFFDPRELRKE
TCLLYEINWGGRHSVWRHTSQNTSNHVEVNFLEKF
TTERYFRPNTRCSITWFLSWSPCGECSRAITEFLS
RHPYVTLFIYIARLYHHTDQRNRQGLRDLISSGVT
IQIMTEQEYCYCWRNFVNYPPSNEAYWPRYPHLWV
KLYVLELYCIILGLPPCLKILRRKQPQLTFFTITL
QTCHYQRIPPHLLWATGLK maAPOBEC-1 *Mesocricetus auratus*
MSSETGPVVVDPTLRRRIEPHEFDAFFDQGELRKE
TCLLYEIRWGGRHNIWRHTGQNTSRHVEINFIEKF
TSERYFYPSTRCSIVWFLSWSPCGECSKAITEFES
GHPNVTLFIYAARLYHHTDQRNRQGLRDLISRGVT
IRIMTEQEYCYCWRNFVNYPPSNEVYWPRYPNLWM
RLYALELYCIHLGLPPCLKIKRRHQYPLTFFRLNL
QSCHYQRIPPHILWATGFI hAPOBEC-1 *Homo sapiens*
MTSEKGPSTGDPTLRRRIEPWEFDVFYDPRELRKE
ACLLYEIKWGMSRKIWRSSGKNTTNHVEVNFIKKF
TSERDFHPSMSCSITWFLSWSPCWECSQAIREFLS
RHPGVTLVIYVARLFWHMDQQNRQGLRDLVNSGVT TABLE 9 -continued Deaminases Screened using
in cis-in trans assay IQIMRASEYYHCWRNFVNYPPGDEAHVVPQYPPLW
MMLYALELHCIILSLPPCLKISRRWQNHLTFFRLH
LQNCHYQTIPPHILLATGLIHPSVAWR
ppAPOBEC-1 *Pongo pygmaeus*

MTSEKGPSTGDPTLRRRIESWEFDVFYDPRELRKE
TCLLYEIKWGMSRKIWRSSGKNTTNHVEVNFIKKF
TSERRFH
SSISCSITWFLSWSPCWECSQAIREFLSQHPGVTL
VIYVARLFWHMDQRNRQGLRDLVNSGVTIQIMR
ASEYVHCWRNFVNYPPDEAFIWPQYPPLWMMLYA
LELHCIILSLPPCLKISRRWQNHLAFFRLHLQNCH
YQTIPPHILLATGLIHPSVTWR ocAPOBEC1 *Oryctolagus cuniculus*
MASEKGPSNKDYTLRRRIEPWEFEVFFDPQELRKE
ACLLYEIKWGASSKTWRSSGKNTTNHVEVNFLEKL
TSEGRLGPSTCCSITWFLSWSPCWECSMAIREFLS
QHPGVTLIIFVARLFQHMDRRNRQGLKDLVTSGVT
VRVMSVSEYCYCWENFVNYPPGKAAQWPRYPPRWM
LMYALELYCIILGLPPCLKISRRHQKQLTFFSLTP
QYCHYKMIPPYILLATGLLQPSVPWR mdAPOBEC-1 *Monodelphis domestica*
MNSKTGPSVGDATLRRRIKPWEFVAFFNPQELRKE
TCLLYEIKWGNQNIWRHSNQNTSQHAEINFMEKFT
AERHFNSSVRCSITWFLSWSPCWECSKAIRKFLDH
YPNVTLAIFISRLYWHIMDQQHRQGLKELVHSGVT
IQIMSYSEYHYCWRNFVDYPQGEEDYWPKYPYLWI
MLYVLELHCIILGLPPCLKISGSHSNQLALFSLDL
QDCHYQKIPYNVLVATGLVQPFVTWR
mAPOBEC-2 *Mus musculus*

MAQKEEAAEAAAPASQNGDDLENLEDPEKLKELID
LPPFEIVTGVRLPVNFFKFQFRNVEYSSGRNKTFL
CYVVEVQSKGGQAQATQGYLEDEHAGAHAEEAFFN
TILPAFDPALKYNVTWYVSSSPCAACADRILKTLS
KTKNLRLLILVSRLFMWEEPEVQAALKKLKEAGCK
LRIMKPQDFEYIWQNFVEQEEGESKAFEPWEDIQE
NFLYYEEKLADILK hAPOBEC-2 *Homo sapiens*
MAQKEEAAVATEAASQNGEDLENLDDPEKLKELIE
LPPFEIVTGERLPANFFKFQFRNVEYSSGRNKTFL
CYVVEAQGKGGQVQASRGYLEDEHAAAHAEEAFFN
TILPAFDPALRYNVTWYVSSSPCAACADRIIKTLS
KTKNLRLLILVGRLFMWEEPEIQAALKKLKEAGCK
LRIMKPQDFEYVWQNFVEQEEGESKAFQPWEDIQE
NFLYYEEKLADILK ppAPOBEC-2 *Pongo pygmaeus*
MAQKEEAAAATEAASQNGEDLENLDDPEKLKELIE
LPPFEIVTGERLPANFFKFQFRNVEYSSGRNKTFL
CYVVEAQGKGGQVQASRGYLEDEHAAAHAEEAFFN
TILPAFDPALRYNVTWYVSSSPCAACADRIIKTLS
KTKNLRLLILVGRLFMWEELEIQDALKKLKEAGCK
LRIMKPQDFEYVWQNFVEQEEGESKAFQPWEDIQE
NFLYYEEKLADILK btAPOBEC-2 *Bos Taurus*
MAQKEEAAAAAEPASQNGEEVENLEDPEKLKELI
ELPPFEIVTGERLPAHYFKFQFRNVE
YSSGRNKTFLCYVVEAQSKGGQVQASRGYLEDEHA
TNHAEEAFFNSIMPTFDPALRYMVTWYVSSSPCAA
CADRIVKTLNKTKNLRLLILVGRLFMWEEPEIQAA
LRKLKEAGCRLRIMKPQDFEYIWQNFVEQEEGESK
AFEPWEDIQENFLYYEEKLADILK mAPOBEC-3 *Mus musculus*
MQPQRLGPRAGMGPFCLGCSHRKCYSPIRNLISQE
TPKFHFKNLGYAKGRKDTFLCYEVTRKDCDSPVSL
HHGVFKNKDNIHAEICFLYWFHDKVLKVLSPREEF
KITWYMSWSPCFECAEQIVRFLATHHNLSLDIFSS
RLYNVQDPETQQNLCRLVQEGAQVAAMDLYEFKKC
WKKFVDNGGRRFRPWKRLLTNFRYQDSKLQEILRP
CYISVPSSSSTLSNICLTKGLPETRFWVEGRRMD
PLSEEEFYSQFYNQRVKHLCYYHRMKPYLCYQLEQ FNGQAPLKGCLLSEKGKQHAEILFLDKIRSMELSQ
VTITCYLTWSPCPNCAWQLAAFKRDRPDLILHIYT
SRLYFHWKRPFQKGLCSLWQSGILVDVMDLPQFTD
CWTNFVNPKRPFWPWKGLEIISRRTQRRLRRIKES
WGLQDLVNDFGNLQLGPPMS hAPOBEC-3A *Homo sapiens*
MEASPASGPRHLMDPHIFTSNFNNGIGRHKTYLCY
EVERLDNGTSVKMDQHRGFLHNQAKNLLCGFYGRH
AELRFLDLVPSLQLDPAQIYRVTWFISWSPCFSWG
CAGEVRAFLQENTHVRLRIFAARIYDYDPLYKEAL
QMLRDAGAQVSIMTYDEFKHCWDTFVDHQGCPFQP
WDGLDEHSQALSGRLRAILQNQGN hAPOBEC-3B *Homo sapiens*
MNPQIRNPMERMYRDTFYDNFENEPILYGRSYTWL
CYEVKIKRGRSNLLWDTGVFRGQVYFKPQYHAEMC
FLSWFCGNQLPAYKCFQITWFVSWTPCPDCVAKLA
EFLSEHPNVTLTISAARLYYYWERDYRRALCRLSQ
AGARVTIMDYEEFAYCWENFVYNEGQQFMPWYKFD
ENYAFLHRTLKEILRYLMDPDTFTFNFNNDPLVLR
RRQTYLCYEVERLDNGTWVLMDQHMGFLCNEAKNL
LCGFYGRHAELRFLDLVPSLQLDPAQIYRVTWFIS
WSPCFSWGCAGEVRAFLQENTHVRLRIFAARIYDY
DPLYKEALQMLRDAGAQVSIMTYDEFEYCWDTFVY
RQGCPFQPWDGLEEHSQALSGRLRAILQNQGN hAPOBEC-3 C *Homo sapiens*
MNPQIRNPMKAMYPGTFYFQFKNLWEANDRNETWL
CFTVEGIKRRSVVSWKTGVFRNQVDSETHCHAERC
FLSWFCDDILSPNTKYQVTWYTSWSPCPDCAGEVA
EFLARHSNVNLTIFTARLYYFQYPCYQEGLRSLSQ
EGVAVEIMDYEDFKYCWENFVYNDNEPFKPWKGLK
TNFRLLKRRLRESLQ hAPOBEC-3D *Homo sapiens*
MNPQIRNPMERMYRDTFYDNFENEPILYGRSYT
WLCYEVKIKRGRSNLLWDTGVFRGPVLPKRQSNHR
QEVYFRFENHAEMCFLSWFCGNRLPANRRFQITWF
VSWNPCLPCVVKVTKFLAEHPNVTLTISAARLYYY
RDRDWRWVLLRLHKAGARVKIMDYEDFAYCWENFV
CNEGQPFMPWYKFDDNYASLHRTLKEILRNPMEAM
YPHIFYFHFKNLLKACGRNESWLCFTMEVTKHHSA
VFRKRGVFRNQVDPETHCHAERCFLSWFCDDILSP
NTNYEVTWYTSWSPCPECAGEVAEFLARHSNVNLT
IFTARLCYFWDTDYQEGLCSLSQEGASVKIMGYKD
FVSCWKNFVYSDDEPFKPWKGLQTNFRLLKRRLRE
ILQ hAPOBEC-3F *Homo sapiens*
MKPHFRNTVERMYRDTFSYNFRNRPILSRRNTVWL
CYEVKTKGPSRPRLDAKIFRGQVYSQPEHHAEMCF
LSWFCGNQLPAYKCFQITWFVSWTPCPDCVAKLAE
FLAEHPNVTLTISAARLYYWERDYRRALCRLSQAG
ARVKIMDDEEFAYCWENFVYSEGQPFMPWYKFDDN
YAFLHRTLKEILRNPMEAMYPHIFYFHFKNLRKAY
GRNESWLCFTMEVVKHHSPVSWKRGVFRNQVDPET
HCHAERCFLSWFCDDILSPNTNYEVTWYTSWSPCP
ECAGEVAEFLARHSNVNLTIFTARLYYFWDTDYQE
GLRSLSQEGASVEIMGYKDFKYCWENFVYNDDEPF
KPWKGLKYNFLFLDSKLQEILE hAPOBEC-3G *Homo sapiens*
MKPHFRNTVERMYRDTFSYNFYNRIILSRRNTVWL
CYEVKTKGPSRPPLDAKIFRGQVYSELKYHPEMRF
FHVVFSKWRKLHRDQEYEVTWYISWSPCTKCTRDM
ATFLAEDPKVTLTIFVARLYYFWDPDYQEALRSLC
QKRDGPRATMKIMNYDEFQHCWSKFVYSQRELFEP
WNNLPKYYILLHIMLGEILRHSMDPPTFTFNFNNE
PWVRGREIETYLCYEVERMHNDTWVLLNQRRGFLC
NQAPHKHGFLEGRHAELCFLDVIPFWKLDLDQDYR
VTCFTSWSPCFSCAQEMAKFISKNKHVSLCIFTAR
IYDDQGRCQEGLRTLAEAGAKISIMTYSEFKHCWD
TFVDHQGCPFQPWDGLDEHSQDLSGRLRAILQNQE
N TABLE 9 -continued Deaminases Screened using
in cis-in trans assay hAPOBEC-4 *Homo sapiens*
MKPFTFRNTVERMYRDTFSYNFYNRPILSRRNTVW
LCYEVKTKGPSRPPLDAKIFRGQVYSELKYHPEMR
FFHWFSKWRKLFIRDQEYEVTWYISWSPCTKCTRD
MATFLAEDPKVTLTIFVARLYYFWDPDYQEALRSL
CQKRDGPRATMKIMNYDEFQHCWSKFVYSQRELFE
PWNNLPKYYILLHIMLGEILRHSMDPPTFTFNFNN
EPWVRGRHETYLCYEVERMHNDTWVLLNQRRGFLC
NQAPHKHGFLEGRHAELCFLDVIPFWKLDLDQDYR
VTCFTSWSPCFSCAQEMAKFISKNKHVSLCIFTAR
IYDDQGRCQEGLRTLAEAGAKISIMTYSEFKHCWD
TFVDHQGCPFQPWDGLDEHSQDLSGRLRAILQNQE
N mAPOBEC-4 *Mus musculus*
MDSLLMKQKKFLYHFKNVRWAKGRHETYLCYVVKR
RDSATSCSLDFGHLRNKSGCHVELLFLRYISDWDL
DPGRCYRVTWFTSWSPCYDCARHVAEFLRWNPNLS
LRIFTARLYFCEDRKAEPEGLRRLEIRAGVQIGIM
TFKDYFYCWNTFVENRERTFKAWEGLHENSVRLTR
QLRRILLPLYEVDDLRDAFRMLGF rAPOBEC-4 *Rattus norvegicus*
MEPLYEEYLTHSGTIVKPYYWLSVSLNCTNCPYHI
RTGEEARVPYTEFHQTFGFPWSTYPQTKHLTFYEL
RSSSGNLIQKGLASNCTGSHTHPESMLFERDGYLD
SLIFHDSNIRHIILYSNNSPCDEANHCCISKMYNF
LMNYPEVTLSVFFSQLYHTENQFPTSAWNREALRG
LASLWPQVTLSAISGGIWQSILETFVSGISEGLTA
VRPFTAGRTLTDRYNAYEINCITEVKPYFTDALHS
WQKENQDQKVWAASENQPLHNTTPAQWQPDMSQDC
RTPAVFMLVPYRDLPPIHVNPSPQKPRTVVRHLNT
LQLSASKVKALRKSPSGRPVKKEEARKGSTRSQEA
NETNKSKWKKQTLFIKSNICHLLEREQKKIGILSS
WSV mIAPOBEC-4 *Macaca fascicularis*
MEPTYEEYLANHGTIVKPYYWLSFSLDCSNCPYHI
RTGEEARVSLTEFCQIFGFPYGTTYPQTKHLTFYE
LKTSSGSLVQKGHASSCTGNYIHPESMLFEMNGYL
DSAIYNNDSIRHIILYCNNSPCNEANHCCISKVYN
FLITYPGITLSIYFSQLYHTEMDFPASAWNREALR
SLASLWPRVVLSPISGGIWHSIWRHTSVSGVSGSHV
FQPILTGRALTDRYNAYEINAITGVKPFFTDVLLH
TKRNPNTKAQMALESYPLNNAFPGQSFQMTSGIPP
DLRAPVVFVLLPLRDLPPMHMGQDPNKPRNIIRHL
NMPQMSFQETKDLERLPTRRSVETVEITERFASSK
QAEEKTKKKKGKK hAID *Homo sapiens*
MDSLLMNRRKFLYQFKNVRWAKGRRETYLCYVVKR
RDSATSFSLDFGYLRNKNGCHVELLFLRYISDWDL
DPGRCYRVTWFTSWSPCYDCARHVADFLRGNPNLS
LRIFTARLYFCEDRKAEPEGLRRLHRAGVQIAIMT
FKDYFYCWNTFVENHERTFKAWEGLHENSVRLSRQ
LRRILLPLYEVDDLRDAFRTLGL clAID *Canis lupus familiaris*
MDSLLMKQRKFLYHFKNVRWAKGREIETYLCYVVK
RRDSATSFSLDFGHLRNKSGCHVELLFLRYISDWD
LDPGRCYRVTWFTSWSPCYDCARHVADFLRGYPNL
SLRIFAARLYFCEDRKAEPEGLRRLHRAGVQIAII
VITFKDYFYCWNTFVENREKTFKAWEGLHENSVRL
SRQLRRILLPLYEVDDLRDAFRTLGL btAID *Bos Taurus*
MDSLLKKQRQFLYQFKNVRWAKGRHETYLCYVVKR
RDSPTSFSLDFGHLRNKAGCHVELLFLRYISDWDL
DPGRCYRVTWFTSWSPCYDCARHVADFLRGYPNLS
LRIFTARLYFCDKERKAEPEGLRRLHRAGVQIAII
VITFKDYFYCWNTFVENHERTFKAWEGLHENSVRL
SRQLRRILLPLYEVDDLRDAFRTLGL mAID *Mus musculus*
MDSLLMNRRKFLYQFKNVRWAKGRRETYLCYVVKR
RDSATSFSLDFGYLRNKNGCHVELLFLRYISDWDL
DPGRCYRVTWFTSWSPCYDCARHVADFLRGNPNLS TABLE 9 -continued Deaminases Screened using
in cis-in trans assay LRIFTARLYFCEDRKAEPEGLRRLHRAGVQIAIIV
ITFKDYFYCWNTFVENHERTFKAWEGLHENSVRLS
RQLRRILLPLYEVDDLRDAFRTLGL pmCDA-1 *Petromyzon marinus*
MAGYECVRVSEKLDFDTFEFQFENLHYATERFIRT
YVIEDVKPQSAGGRSRRLWGYIINNPNVCHAELIL
MSMIDRHLESNPGVYAMTWYMSWSPCANCSSKLNP
WLKNLLEEQGHTLTMHFSRIYDRDREGDHRGLRGL
KHVSNSFRMGVVGRAEVKECLAEYVEASRRTLTWL
DTTESMAAKMRRKLFCILVRCAGMRESGIPLHLFT
LQTPLLSGRVVWWRV pmCDA-2 *Petromyzon marinus*
MELREVVDCALASCVRHEPLSRVAFLRCFAAPSQK
PRGTVILFYVEGAGRGVTGGHAVNYNKQGTSIHAE
VLLLSAVRAALLRRRRCEDGEEATRGCTLHCYSTY
SPCRDCVEYIQEFGASTGVRVVIHCCRLYELDVNR
RRSEAEGVLRSLSRLGRDFRLMGPRDAIALLLGGR
LANTADGESGASGNAWVTETNVVEPLVDMTGFGDE
DLHAQVQRNKQIREAYANYASAVSLMLGELHVDPD
KFPFLAEFLAQTSVEPSGTPRETRGRPRGASSRGP
EIGRQRPADFERALGAYGLFLHPRIVSREADREEI
KRDLIVVMRKHNYQGP pm CDA-5 *Petromyzon marinus*
MAGDENVRVSEKLDFDTFEFQFENLHYATERHRTY
VIFDVKPQSAGGRSRRLWGYIINNPNVCHAELILM
SMIDRHLESNPGVYAMTWYMSWSPCANCSSKLNPW
LKNLLEEQGHTLMMHFSRIYDRDREGDFIRGLRGL
KHVSNSFRMGVVGRAEVKECLAEYVEASRRTLTWL
DTTESMAAKMRRKLFCILVRCAGMRESGMPLHLFT yCD *Saccharomyces cerevisiae*
MVTGGMASKWDQKGMDIAYEEAALGYKEGGVPIGG
CLINNKDGSVLGRGHNMRFQKGSATLHGEISTLEN
CGRLEGKVYKDTTLYTTLSPCDMCTGAIIMYGIPR
CVVGENVNFKSKGEKYLQTRGHEVVVVDDERCKKI
MKQFIDERPQDWFEDIGE rAPOBEC-1 (delta 177-186)
MSSETGPVAVDPTLRRRIEPHEFEVFFDPRELRKE
TCLLYEINWGGRHSIWRHTSQNTNKHVEVNFIEKF
TTERYFCPNTRCSITWFLSWSPCGECSRAITEFLS
RYPHVTLFIYIARLYHHADPRNRQGLRDLISSGVT
IQIMTEQESGYCWRNFVNYSPSNEAHWPRYPHLWV
RGLPPCLNILRRKQPQLTFFTIALQSCHYQRLPPH
ILWATGLK rAPOBEC-1 (delta 202-213)
MSSETGPVAVDPTLRRRIEPHEFEVFFDPRELRKE
TCLLYEINWGGRHSIWRHTSQNTNKHVEVNFIEKF
TTERYFCPNTRCSITWFLSWSPCGECSRAITEFLS
RYPHVTLFIYIARLYHHADPRNRQGLRDLISSGVT
IQIMTEQESGYCWRNFVNYSPSNEAHWPRYPHLWV
RLYVLELYCIILGLPPCLNILRRKQPQHYQRLPPH
ILWATGLK

Example 4: Construction of CBE and ABE Internal Fusions

CBE and ABE internal fusion constructs were generated by cloning deaminases into a high b-factor position within SpCas9 or SpCas9 nickase with a D10A mutation. In some cases, a structural or functional domain of the Cas9 was partially or deleted and replaced with a TadA domain (IBE020). CBEs were inserted in the same manner and were modified on the C-terminal end with a uracil DNA glyco-sylase inhibitor (UGI) domain.

Exemplary internal fusions base editors are provided in Table 10 below:

TABLE 10

| BE ID | Modification | Other ID |
|---|---|---|
| IBE001 | Cas9 TadA ins 1015 | ISLAY01 |
| IBE002 | Cas9 TadA ins 1022 | ISLAY02 |
| IBE003 | Cas9 TadA ins 1029 | ISLAY03 |
| IBE004 | Cas9 TadA ins 1040 | ISLAY04 |
| IBE005 | Cas9 TadA ins 1068 | ISLAY05 |
| IBE006 | Cas9 TadA ins 1247 | ISLAY06 |
| IBE007 | Cas9 TadA ins 1054 | ISLAY07 |
| IBE008 | Cas9 TadA ins 1026 | ISLAY08 |
| IBE009 | Cas9 TadA ins 768 | ISLAY09 |
| IBE020 | delta HNH TadA 792 | ISLAY20 |
| IBE021 | N-term fusion single TadA helix truncated 165-end | ISLAY21 |
| IBE029 | TadA-Circular Permutant116 ins1067 | ISLAY29 |
| IBE031 | TadA-Circular Permutant 136 ins1248 | ISLAY31 |
| IBE032 | TadA-Circular Permutant 136ins 1052 | ISLAY32 |
| IBE035 | delta 792-872 TadA ins | ISLAY35 |
| IBE036 | delta 792-906 TadA ins | ISLAY36 |
| IBE043 | TadA-Circular Permutant 65 ins1246 | ISLAY43 |
| IBE044 | TadA ins C-term truncate2 791 | ISLAY44 |
| HR001 | GGS-rAPOBEC1-XTEN-ins-site1_Y1016-D10A-UGIx2 | pHRB-043 |
| HR002 | GGS-rAPOBEC1-XTEN ins-site2_A1023-D10A-UGIx2 | pHRB-044 |
| HR003 | GGS-rAPOBEC1-XTEN ins-site3_E1029-D10A-UGIx2 | pHRB-045 |
| | GGS-rAPOBEC1-XTEN ins-site4_N1040-D10A-UGIx2 | pHRB-046 |
| HR004 | GGS-rAPOBEC1-XTEN ins-site5-T1069-D10A-UGIx2 | pHRB-047 |
| HR005 | GGS-rAPOBEC1-XTEN ins-site6-G1247-D10A-UGIx2 | pHRB-048 |

Sequences of the constructs are provided below.

```
Cas9 TadAins 1015
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG
```

-continued

```
CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT
```

-continued

```
ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGGGTTCTAGCGGCAGCGAGACTCCCGGGACCTCAGA

GTCCGCCACACCCGAAAGTTCTGGTTCCGAAGTCGAGTTT

TCCCATGAGTACTGGATGAGACACGCATTGACTCTCGCAA

AGAGGGCTCGAGATGAACGCGAGGTGCCCGTGGGGGCAGT

ACTCGTGCTCAACAATCGCGTAATCGGCGAAGGTTGGAAT

AGGGCAATCGGACTCCACGACCCCACTGCACATGCGGAAA

TCATGGCCCTTCGACAGGGAGGGCTTGTGATGCAGAATTA

TCGACTTATCGATGCGACGCTGTACGTCACGTTTGAACCT

TGCGTAATGTGCGCGGGAGCTATGATTC

ACTCCCGCATTGGACGAGTTGTATTCGGTGTTCGCAACGC

CAAGACGGGTGCCGCAGGTTCACTGATGGACGTGCTGCAT

TACCCAGGCATGAACCACCGGGTAGAAATCACAGAAGGCA

TATTGGCGGACGAATGTGCGGCGCTGTTGTGTTACTTTTT

TCGCATGCCCAGGCAGGTCTTTAACGCCCAGAAAAAAGCA

CAATCCTCTACTGACTACGACGTGCGGAAGATGATCGCCA

AGAGCGAGCAGGAAATCGGCAAGGCTACCGCCAAGTACTT

CTTCTACAGCAACATCATGAACTTTTTCAAGACCGAGATT

ACCCTGGCCAACGGCGAGATCCGGAAGCGGCCTCTGATCG

AGACAAACGGCGAAACCGGGGAGATCGTGTGGGATAAGGG

CCGGGATTTTGCCACCGTGCGCGAAAGTGCTGAGCATGCCC

CAAGTGAATATCGTGAAAAAGACCGAGGTGCAGACAGGCG

GCTTCAGCAAAGAGTCTATCCTGCCCAAGAGGAACAGCGA

TAAGCTGATCGCCAGAAAGAAGGACTGGGACCCTAAGAAG

TACGGCGGCTTCGACAGCCCCACCGTGGCCTATTCTGTGC

TGGTGGTGGCCAAAGTGGAAAAGGGCAAGTCCAAGAAACT
```

-continued

```
GAAGAGTGTGAAAGAGCTGCTGGGGATCACCATCATGGAA

AGAAGCAGCTTCGAGAAGAATCCCATCGACTTTCTGGAAG

CCAAGGGCTACAAAGAAGTGAAAAAGGACCTGATCATCAA

GCTGCCTAAGTACTCCCTGTTCGAGCTGGAAAACGGCCGG

AAGAGAATGCTGGCCTCTGCCGGCGAACTGCAGAAGGGAA

ACGAACTGGCCCTGCCCTCCAAATATGTGAACTTCCTGTA

CCTGGCCAGCCACTATGAGAAGCTGAAGGGCTCCCCCGAG

GATAATGAGCAGAAACAGCTGTTTGTGGAACAGCACAAGC

ACTACCTGGACGAGATCATCGAGCAGATCAGCGAGTTCTC

CAAGAGAGTGATCCTGGCCGACGCTAATCTGGACAAAGTG

CTGTCCGCCTACAACAAGCACCGGGATAAGCCCATCAGAG

AGCAGGCCGAGAATATCATCCACCTGTTTACCCTGACCAA

TCTGGGAGCCCCTGCCGCCTTCAAGTACTTTGACACCACC

ATCGACCGGAAGAGGTACACCAGCACCAAAGAGGTGCTGG

ACGCCACCCTGATCCACCAGAGCATCACCGGCCTGTACGA

GACACGGATCGACCTGTCTCAGCTGGGAGGTGAC
```

Cas9 TadAins 1015
```
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSQILKEHP

VENTQLQNEKLYLYYLQNGRDMYVDQELDINRLSDYDVDH

IVPQSFLKDDSIDNKVLTRSDKNRGKSDNVPSEEVVKKMK

NYWRQLLNAKLITQRKFDNLTKAERGGLSELDKAGFIKRQ

LVETRQITKHVAQILDSRMNTKYDENDKLIREVKVITLKS
```

-continued

KLVSDFRKDFQFYKVREINNYHHAHDAYLNAVVGTALIKK

YPKLESEFVYGDYKVGSSGSETPGTSESATPESSGSEVEF

SHEYWMRHALTLAKRARDEREVPVGAVLVLNNRVIGEGWN

RAIGLHDPTAHAEIMALRQGGLVMQNYRLIDATLYVTFEP

CVMCAGAMIHSRIGRVVFGVRNAKTGAAGSLMDVLHYPGM

NERVEITEGILADECAALLCYFFRMPRQVFNAQKKAQSST

DYDVRKMIAKSEQEIGKATAKYFFYSNIMNFFKTEITLAN

GEIRKRPLIETNGETGEIVWDKGRDFATVRKVLSMPQVNI

VKKTEVQTGGFSKESILPKRNSDKLIARKKDWDPKKYGGF

DSPTVAYSVLVVAKVEKGKSKKLKSVKELLGITIMERSSF

EKNPIDFLEAKGYKEVKKDLIIKLPKYSLFELENGRKRML

ASAGELQKGNELALPSKYVNFLYLASHYEKLKGSPEDNEQ

KQLFVEQHKHYLDEIIEQISEFSKRVILADANLDKVLSAY

NKHRDKPIREQAENIIHLFTLTNLGAPAAFKYFDTTIDRK

RYTSTKEVLDATLIHQSITGLYETRIDLSQLGGD

Cas9 TadAins 1022
ATGGACAAGAAGTACAGCATCGGCCTGGCCATCGGCACCAA

CTCTGTGGGCTGGGCCGTGATCACCGACGAGTACAAGGTG

CCCAGCAAGAAATTCAAGGTGCTGGGCAACACCGACCGGC

ACAGCATCAAGAAGAACCTGATCGGAGCCCTGCTGTTCGA

CAGCGGCGAAACAGCCGAGGCCACCCGGCTGAAGAGAACC

GCCAGAAGAAGATACACCAGACGGAAGAACCGGATCTGCT

ATCTGCAAGAGATCTTCAGCAACGAGATGGCCAAGGTGGA

CGACAGCTTCTTCCACAGACTGGAAGAGTCCTTCCTGGTG

GAAGAGGATAAGAAGCACGAGCGGCACCCCATCTTCGGCA

ACATCGTGGACGAGGTGGCCTACCACGAGAAGTACCCCAC

CATCTACCACCTGAGAAAGAAACTGGTGGACAGCACCGAC

AAGGCCGACCTGCGGCTGATCTATCTGGCCCTGGCCCACA

TGATCAAGTTCCGGGGCCACTTCCTGATCGAGGGCGACCT

GAACCCCGACAACAGCGACGTGGACAAGCTGTTCATCCAG

CTGGTGCAGACCTACAACCAGCTGTTCGAGGAAAACCCCA

TCAACGCCAGCGGCGTGGACGCCAAGGCCATCCTGTCTGC

CAGACTGAGCAAGAGCAGACGGCTGGAAAATCTGATCGCC

CAGCTGCCCGGCGAGAAGAAGAATGGCCTGTTCGGAAACC

TGATTGCCCTGAGCCTGGGCCTGACCCCCAACTTCAAGAG

CAACTTCGACCTGGCCGAGGATGCCAAACTGCAGCTGAGC

AAGGACACCTACGACGACGACCTGGACAACCTGCTGGCCC

AGATCGGCGACCAGTACGCCGACCTGTTTCTGGCCGCCAA

GAACCTGTCCGACGCCATCCTGCTGAGCGACATCCTGAGA

GTGAACACCGAGATCACCAAGGCCCCCCTGAGCGCCTCTA

TGATCAAGAGATACGACGAGCACCACCAGGACCTGACCCT

-continued

GCTGAAAGCTCTCGTGCGGCAGCAGCTGCCTGAGAAGTAC

AAAGAGATTTTCTTCGACCAGAGCAAGAACGGCTACGCCG

GCTACATTGACGGCGGAGCCAGCCAGGAAGAGTTCTACAA

GTTCATCAAGCCCATCCTGGAAAAGATGGACGGCACCGAG

GAACTGCTCGTGAAGCTGAACAGAGAGGACCTGCTGCGGA

AGCAGCGGACCTTCGACAACGGCAGCATCCCCCACCAGAT

CCACCTGGGAGAGCTGCACGCCATTCTGCGGCGGCAGGAA

GATTTTTACCCATTCCTGAAGGACAACCGGGAAAAGATCG

AGAAGATCCTGACCTTCCGCATCCCCTACTACGTGGGCCC

TCTGGCCAGGGGAAACAGCAGATTCGCCTGGATGACCAGA

AAGAGCGAGGAAACCATCACCCCCTGGAACTTCGAGGAAG

TGGTGGACAAGGGCGCTTCCGCCCAGAGCTTCATCGAGCG

GATGACCAACTTCGATAAGAACCTGCCCAACGAGAAGGTG

CTGCCCAAGCACAGCCTGCTGTACGAGTACTTCACCGTGT

ATAACGAGCTGACCAAAGTGAAATACGTGACCGAGGGAAT

GAGAAAGCCCGCCTTCCTGAGCGGCGAGCAGAAAAAGGCC

ATCGTGGACCTGCTGTTCAAGACCAACCGGAAAGTGACCG

TGAAGCAGCTGAAAGAGGACTACTTCAAGAAAATCGAGTG

CTTCGACTCCGTGGAAATCTCCGGCGTGGAAGATCGGTTC

AACGCCTCCCTGGGCACATACCACGATCTGCTGAAAATTA

TCAAGGACAAGGACTTCCTGGACAATGAGGAAAACGAGGA

CATTCTGGAAGATATCGTGCTGACCCTGACACTGTTTGAG

GACAGAGAGATGATCGAGGAACGGCTGAAAACCTATGCCC

ACCTGTTCGACGACAAAGTGATGAAGCAGCTGAAGCGGCG

GAGATACACCGGCTGGGGCAGGCTGAGCCGGAAGCTGATC

AACGGCATCCGGGACAAGCAGTCCGGCAAGACAATCCTGG

ATTTCCTGAAGTCCGACGGCTTCGCCAACAGAAACTTCAT

GCAGCTGATCCACGACGACAGCCTGACCTTTAAAGAGGAC

ATCCAGAAAGCCCAGGTGTCCGGCCAGGGCGATAGCCTGC

ACGAGCACATTGCCAATCTGGCCGGCAGCCCCGCCATTAA

GAAGGGCATCCTGCAGACAGTGAAGGTGGTGGACGAGCTC

GTGAAAGTGATGGGCCGGCACAAGCCCGAGAACATCGTGA

TCGAAATGGCCAGAGAGAACCAGACCACCCAGAAGGGACA

GAAGAACAGCCGCGAGAGAATGAAGCGGATCGAAGAGGGC

ATCAAAGAGCTGGGCAGCCAGATCCTGAAAGAACACCCCG

TGGAAAACACCCAGCTGCAGAACGAGAAGCTGTACCTGTA

CTACCTGCAGAATGGGCGGGATATGTACGTGGACCAGGAA

CTGGACATCAACCGGCTGTCCGACTACGATGTGGACCATA

TCGTGCCTCAGAGCTTTCTGAAGGACGACTCCATCGACAA

CAAGGTGCTGACCAGAAGCGACAAGAACCGGGGCAAGAGC

GACAACGTGCCCTCCGAAGAGGTCGTGAAGAAGATGAAGA

-continued

```
ACTACTGGCGGCAGCTGCTGAACGCCAAGCTGATTACCCA

GAGAAAGTTCGACAATCTGACCAAGGCCGAGAGAGGCGGC

CTGAGCGAACTGGATAAGGCCGGCTTCATCAAGAGACAGC

TGGTGGAAACCCGGCAGATCACAAAGCACGTGGCACAGAT

CCTGGACTCCCGGATGAACACTAAGTACGACGAGAATGAC

AAGCTGATCCGGGAAGTGAAAGTGATCACCCTGAAGTCCA

AGCTGGTGTCCGATTTCCGGAAGGATTTCCAGTTTTACAA

AGTGCGCGAGATCAACAACTACCACCACGCCCACGACGCC

TACCTGAACGCCGTCGTGGGAACCGCCCTGATCAAAAAGT

ACCCTAAGCTGGAAAGCGAGTTCGTGTACGGCGACTACAA

GGTGTACGACGTGCGGAAGATGATCGGTTCTAGCGGCAGC

GAGACTCCCGGGACCTCAGAGTCCGCCACACCCGAAAGTT

CTGGTTCCGAAGTCGAGTTTTCCCATGAGTACTGGATGAG

ACACGCATTGACTCTCGCAAAGAGGGCTCGAGATGAACGC

GAGGTGCCCGTGGGGGCAGTACTCGTGCTCAACAATCGCG

TAATCGGCGAAGGTTGGAATAGGGCAATCGGACTCCACGA

CCCCACTGCACATGCGGAAATCATGGCCCTTCGACAGGGA

GGGCTTGTGATGCAGAATTATCGACTTATCGATGCGACGC

TGTACGTCACGTTTGAACCTTGCGTAATGTGCGCGGGAGC

TATGATTCACTCCCGCATTGGACGAGTTGTATTCGGTGTT

CGCAACGCCAAGACGGGTGCCGCAGGTTCACTGATGGACG

TGCTGCATTACCCAGGCATGAACCACCGGGTAGAAATCAC

AGAAGGCATATTGGCGGACGAATGTGCGGCGCTGTTGTGT

TACTTTTTTCGCATGCCCAGGCAGGTCTTTAACGCCCAGA

AAAAAGCACAATCCTCTACTGACGCCAAGAGCGAGCAGGA

AATCGGCAAGGCTACCGCCAAGTACTTCTTCTACAGCAAC

ATCATGAACTTTTTCAAGACCGAGATTACCCTGGCCAACG

GCGAGATCCGGAAGCGGCCTCTGATCGAGACAAACGGCGA

AACCGGGGAGATCGTGTGGGATAAGGGCCGGGATTTTGCC

ACCGTGCGGAAAGTGCTGAGCATGCCCCAAGTGAATATCG

TGAAAAAGACCGAGGTGCAGACAGGCGGCTTCAGCAAAGA

GTCTATCCTGCCCAAGAGGAACAGCGATAAGCTGATCGCC

AGAAAGAAGGACTGGGACCCTAAGAAGTACGGCGGCTTCG

ACAGCCCCACCGTGGCCTATTCTGTGCTGGTGGTGGCCAA

AGTGGAAAAGGGCAAGTCCAAGAAACTGAAGAGTGTGAAA

GAGCTGCTGGGGATCACCATCATGGAAAGAAGCAGCTTCG

AGAAGAATCCCATCGACTTTCTGGAAGCCAAGGGCTACAA

AGAAGTGAAAAAGGACCTGATCATCAAGCTGCCTAAGTAC

TCCCTGTTCGAGCTGGAAAACGGCCGGAAGAGAATGCTGG

CCTCTGCCGGCGAACTGCAGAAGGGAAACGAACTGGCCCT
```

-continued

```
GCCCTCCAAATATGTGAACTTCCTGTACCTGGCCAGCCAC

TATGAGAAGCTGAAGGGCTCCCCCGAGGATAATGAGCAGA

AACAGCTGTTTGTGGAACAGCACAAGCACTACCTGGACGA

GATCATCGAGCAGATCAGCGAGTTCTCCAAGAGAGTGATC

CTGGCCGACGCTAATCTGGACAAAGTGCTGTCCGCCTACA

ACAAGCACCGGGATAAGCCCATCAGAGAGCAGGCCGAGAA

TATCATCCACCTGTTTACCCTGACCAATCTGGGAGCCCCT

GCCGCCTTCAAGTACTTTGACACCACCATCGACCGGAAGA

GGTACACCAGCACCAAAGAGGTGCTGGACGCCCACCCTGAT

CCACCAGAGCATCACCGGCCTGTACGAGACACGGATCGAC

CTGTCTCAGCTGGGAGGTGAC
```

Cas9 TadAins 1022
```
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSQILKEHP

VENTQLQNEKLYLYYLQNGRDMYVDQELDINRLSDYDVDH

IVPQSFLKDDSIDNKVLTRSDKNRGKSDNVPSEEVVKKMK

NYWRQLLNAKLITQRKFDNLTKAERGGLSELDKAGFIKRQ

LVETRQITKHVAQILDSRMNTKYDENDKLIREVKVITLKS

KLVSDFRKDFQFYKVREINNYHHAHDAYLNAVVGTALIKK

YPKLESEFVYGDYKVYDVRKMIGSSGSETPGTSESATPES

SGSEVEFSHEYWMRHALTLAKRARDEREVPVGAVLVLNNR

VIGEGWNRAIGLHDPTAHAEIMALRQGGLVMQNYRLIDAT

LYVTFEPCVMCAGAMIHSRIGRVVFGVRNAKTGAAGSLMD
```

-continued

VLHYPGMNEIRVEITEGILADECAALLCYFFRMPRQVFNA

QKKAQSSTDAKSEQEIGKATAKYFFYSNIMNFFKTEITLA

NGEIRKRPLIETNGETGEIVWDKGRDFATVRKVLSMPQVN

IVKKTEVQTGGFSKESILPKRNSDKLIARKKDWDPKKYGG

FDSPTVAYSVLVVAKVEKGKSKKLKSVKELLGITIMERSS

FEKNPIDFLEAKGYKEVKKDLIIKLPKYSLFELENGRKRM

LASAGELQKGNELALPSKYVNFLYLASHYEKLKGSPEDNE

QKQLFVEQHKHYLDEIIEQISEFSKRVILADANLDKVLSA

YNKHRDKPIREQAENIIHLFTLTNLGAPAAFKYFDTTEDR

KRYTSTKEVLDATLIHQSITGLYETRIDLSQLGGD

IB3E003_Cas9: Cas9 TadAins 1029
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

-continued

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

-continued

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGGAAGATGATCGCCAAGAGCGAGCA

GGAAATCGGTTCTAGCGGCAGCGAGACTCCCGGGACCTCA

GAGTCCGCCACACCCGAAAGTTCTGGTTCCGAAGTCGAGT

TTTCCCATGAGTACTGGATGAGACACGCATTGACTCTCGC

AAAGAGGGCTCGAGATGAACGCGAGGTGCCCGTGGGGGCA

GTACTCGTGCTCAACAATCGCGTAATCGGCGAAGGTTGGA

ATAGGGCAATCGGACTCCACGACCCCACTGCACATGCGGA

AATCATGGCCCTTCGACAGGGAGGGCTTGTGATGCAGAAT

TATCGACTTATCGATGCGACGTGTACGTCACGTTTGAAC

CTTGCGTAATGTGCGCGGGAGCTATGATTCACTCCCGCAT

TGGACGAGTTGTATTCGGTGTTCGCAACGCCAAGACGGGT

GCCGCAGGTTCACTGATGGACGTGCTGCATTACCCAGGCA

TGAACCACGGGTAGAAATCACAGAAGGCATATTGGCGGA

CGAATGTGCGGCGCTGTTGTGTTACTTTTTTCGCATGCCC

AGGCAGGTCTTTAACGCCCAGAAAAAAGCACAATCCTCTA

CTGACGGCAAGGCTACCGCCAAGTACTTCTTCTACAGCAA

CATCATGAACTTTTTCAAGACCGAGATTACCCTGGCCAAC

GGCGAGATCCGGAAGCGGCCTCTGATCGAGACAAACGGCG

AAACCGGGGAGATCGTGTGGGATAAGGGCCGGGATTTTGC

CACCGTGCGGAAAGTGCTGAGCATGCCCCAAGTGAATATC

GTGAAAAAGACCGAGGTGCAGACAGGCGGCTTCAGCAAAG

AGTCTATCCTGCCCAAGAGGAACAGCGATAAGCTGATCGC

CAGAAAGAAGGACTGGGACCCTAAGAAGTACGGCGGCTTC

GACAGCCCCACCGTGGCCTATTCTGTGCTGGTGGTGGCCA

AAGTGGAAAAGGGCAAGTCCAAGAAACTGAAGAGTGTGAA

AGAGCTGCTGGGGATCACCATCATGGAAAGAAGCAGCTTC

GAGAAGAATCCCATCGACTTTCTGGAAGCCAAGGGCTACA

AAGAAGTGAAAAAGGACCTGATCATCAAGCTGCCTAAGTA

CTCCCTGTTCGAGCTGGAAAACGGCCGGAAGAGAATGCTG

GCCTCTGCCGGCGAACTGCAGAAGGGAAACGAACTGGCCC

TGCCCTCCAAATATGTGAACTTCCTGTACCTGGCCAGCCA

CTATGAGAAGCTGAAGGGCTCCCCCGAGGATAATGAGCAG

AAACAGCTGTTTGTGGAACAGCACAAGCACTACCTGGACG

AGATCATCGAGCAGATCAGCGAGTTCTCCAAGAGAGTGAT

CCTGGCCGACGCTAATCTGGACAAAGTGCTGTCCGCCTAC

-continued

AACAAGCACCGGGATAAGCCCATCAGAGAGCAGGCCGAGA

ATATCATCCACCTGTTTACCCTGACCAATCTGGGAGCCCC

TGCCGCCTTCAAGTACTTTGACACCACCATCGACCGGAAG

AGGTACACCAGCACCAAAGAGGTGCTGGACGCCACCCTGA

TCCACCAGAGCATCACCGGCCTGTACGAGACACGGATCGA

CCTGTCTCAGCTGGGAGGTGAC

Cas9 TadAins 1029

MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSQILKEHP

VENTQLQNEKLYLYYLQNGRDMYVDQELDINRLSDYDVDH

IVPQSFLKDDSIDNKVLTRSDKNRGKSDNVPSEEVVKKMK

NYWRQLLNAKLITQRKFDNLTKAERGGLSELDKAGFIKRQ

LVETRQITKHVAQILDSRMNTKYDENDKLIREVKVITLKS

KLVSDFRKDFQFYKVREINNYHHAHDAYLNAVVGTALIKK

YPKLESEFVYGDYKVYDVRKMIAKSEQEIGSSGSETPGTS

ESATPESSGSEVEFSHEYVVMRHALTLAKRARDEREVPVG

AVLVLNNRVIGEGWNRAIGLHDPTAHAEIMALRQGGLVMQ

NYRLIDATLYVTFEPCVMCAGAMIHSRIGRVVFGVRNAKT

GAAGSLMDVLHYPGMNHRVEITEGILADECAALLCYFFRM

PRQVFNAQKKAQSSTDGKATAKYFFYSNIMNFFKTEITLA

NGEIRKRPLIETNGETGEIVWDKGRDFATVRKVLSMPQVN

IVKKTEVQTGGFSKESILPKRNSDKLIARKKDWDPKKYGG

FDSPTVAYSVLVVAKVEKGKSKKLKSVKELLGITIMERSS

-continued

FEKNPIDFLEAKGYKEVKKDLIIKLPKYSLFELENGRKRM

LASAGELQKGNELALPSKYVNFLYLASHYEKLKGSPEDNE

QKQLFVEQHKHYLDEIIEQISEFSKRVILADANLDKVLSA

YNKHRDKPIREQAENIIHLFTLTNLGAPAAFKYFDTTIDR

KRYTSTKEVLDATLIHQSITGLYETRIDLSQLGGD

IRE004_Cas9: Cas9 TadAins 1040
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

-continued

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

-continued

AGGTGTACGACGTGCGGAAGATGATCGCCAAGAGCGAGCA

GGAAATCGGCAAGGCTACCGCCAAGTACTTCTTCTACAGC

GGTTCTAGCGGCAGCGAGACTCCCGGGACCTCAGAGTCCG

CCACACCCGAAAGTTCTGGTTCCGAAGTCGAGTTTTCCCA

TGAGTACTGGATGAGACACGCATTGACTCTCGCAAAGAGG

GCTCGAGATGAACGCGAGGTGCCCGTGGGGGGCAGTACTCG

TGCTCAACAATCGCGTAATCGGCGAAGGTTGGAATAGGGC

AATCGGACTCCACGACCCCACTGCACATGCGGAAATCATG

GCCCTTCGACAGGGAGGGCTTGTGATGCAGAATTATCGAC

TTATCGATGCGACGCTGTACGTCACGTTTGAACCTTGCGT

AATGTGCGCGGGAGCTATGATTCACTCCCGCATTGGACGA

GTTGTATTCGGTGTTCGCAACGCCAAGACGGGTGCCGCAG

GTTCACTGATGGACGTGCTGCATTACCCAGGCATGAACCA

CCGGGTAGAAATCACAGAAGGCATATTGGCGGACGAATGT

GCGGCGCTGTTGTGTTACTTTTTTCGCATGCCCAGGCAGG

TCTTTAACGCCCAGAAAAAAGCACAATCCTCTACTGACAA

CATCATGAACTTTTTCAAGACCGAGATTACCCT

GGCCAACGGCGAGATCCGGAAGCGGCCTCTGATCGAGACA

AACGGCGAAACCGGGGAGATCGTGTGGGATAAGGGCCGGG

ATTTTGCCACCGTGCGGAAAGTGCTGAGCATGCCCCAAGT

GAATATCGTGAAAAAGACCGAGGTGCAGACAGGCGGCTTC

AGCAAAGAGTCTATCCTGCCCAAGAGGAACAGCGATAAGC

TGATCGCCAGAAAGAAGGACTGGGACCCTAAGAAGTACGG

CGGCTTCGACAGCCCCACCGTGGCCTATTCTGTGCTGGTG

GTGGCCAAAGTGGAAAAGGGCAAGTCCAAGAAACTGAAGA

GTGTGAAAGAGCTGCTGGGGATCACCATCATGGAAAGAAG

CAGCTTCGAGAAGAATCCCATCGACTTTCTGGAAGCCAAG

GGCTACAAAGAAGTGAAAAAGGACCTGATCATCAAGCTGC

CTAAGTACTCCCTGTTCGAGCTGGAAAACGGCCGGAAGAG

AATGCTGGCCTCTGCCGGCGAACTGCAGAAGGGAAACGAA

CTGGCCCTGCCCTCCAAATATGTGAACTTCCTGTACCTGG

CCAGCCACTATGAGAAGCTGAAGGGCTCCCCCGAGGATAA

TGAGCAGAAACAGCTGTTTGTGGAACAGCACAAGCACTAC

CTGGACGAGATCATCGAGCAGATCAGCGAGTTCTCCAAGA

GAGTGATCCTGGCCGACGCTAATCTGGACAAAGTGCTGTC

CGCCTACAACAAGCACCGGGATAAGCCCATCAGAGAGCAG

GCCGAGAATATCATCCACCTGTTTACCCTGACCAATCTGG

GAGCCCCTGCCGCCTTCAAGTACTTTGACACCACCATCGA

-continued
CCGGAAGAGGTACACCAGCACCAAAGAGGTGCTGGACGCC

ACCCTGATCCACCAGAGCATCACCGGCCTGTACGAGACAC

GGATCGACCTGTCTCAGCTGGGAGGTGAC

Cas9 TadAins 1040
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMINFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSQILKEHP

VENTQLQNEKLYLYYLQNGRDMYVDQELDINRLSDYDVDH

IVPQSFLKDDSIDNKVLTRSDKNRGKSDNVPSEEVVKKMK

NYWRQLLNAKLITQRKFDNLTKAERGGLSELDKAGFIKRQ

LVETRQITKHVAQILDSRMNTKYDENDKLIREVKVITLKS

KLVSDFRKDFQFYKVREINNYHHAHDAYLNAVVGTALIKK

YPKLESEFVYGDYKVYDVRKMIAKSEQEIGKATAKYFFYS

GSSGSETPGTSESATPESSGSEVEFSHEWMRHALTLAKRA

RDEREVPVGAVLVLNNRVIGEGWNRAIGLHDPTAHAEIMA

LRQGGLVMQNYRLIDATLYVTFEPCVMCAGAMIHSRIGRV

VFGVRNAKTGAAGSLMDVLHYPGMNHRVEITEGILADECA

ALLCYFFRMPRQVFNAQKKAQSSTDNIMNFFKTEITLANG

EIRKRPLIETNGETGEIVWDKGRDFATVRKVLSMPQVNIV

KKTEVQTGGFSKESILPKRNSDKLIARKKDWDPKKYGGFD

SPTVAYSVLVVAKVEKGKSKKLKSVKELLGITIMERSSFE

KNPIDFLEAKGYKEVKKDLIIKLPKYSLFELENGRKRMLA

SAGELQKGNELALPSKYVNFLYLASHYEKLKGSPEDNEQK

QLFVEQHKHYLDEIIEQISEFSKRVILADANLDKVLSAYN

-continued

KHRDKPIREQAENIIHLFTLTNLGAPAAFKYFDTTIDRKR

YTSTKEVLDATLIHQSITGLYETRIDLSQLGGD

IB3E005_Cas9: Cas9 TadAins 1068
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

-continued

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGGAAGATGATCGCCAAGAGCGAGCA

GGAAATCGGCAAGGCTACCGCCAAGTACTTCTTCTACAGC

AACATCATGAACTTTTTCAAGACCGAGATTACCCTGGCCA

-continued

ACGGCGAGATCCGGAAGCGGCCTCTGATCGAGACAAACGG

CGAAGGTTCTAGCGGCAGCGAGACTCCCGGGACCTCAGAG

TCCGCCACACCCGAAAGTTCTGGTTCCGAAGTCGAGTTTT

CCCATGAGTACTGGATGAGACACGCATTGACTCTCGCAAA

GAGGGCTCGAGATGAACGCGAGGTGCCCGTGGGGGCAGTA

CTCGTGCTCAACAATCGCGTAATCGGCGAAGGTTGGAATA

GGGCAATCGGACTCCACGACCCCACTGCACATGCGGAAAT

CATGGCCCTTCGACAGGGAGGGCTTGTGATGCAGAATTAT

CGACTTATCGATGCGACGCTGTACGTCACGTTTGAACCTT

GCGTAATGTGCGCGGGAGCTATGATTCACTCCCGCATTGG

ACGAGTTGTATTCGGTGTTCGCAACGCCAAGACGGGTGCC

GCAGGTTCACTGATGGACGTGCTGCATTACCCAGGCATGA

ACCACCGGGTAGAAATCACAGAAGGCATATTGGCGGACGA

ATGTGCGGCGCTGTTGTGTTACTTTTTTCGCATGCCCAGG

CAGGTCTTTAACGCCCAGAAAAAAGCACAATCCTCTACTG

ACACCGGGGAGATCGTGTGGGATAAGGGCCGGGATTTTGC

CACCGTGCGGAAAGTGCTGAGCATGCCCCAAGTGAATATC

GTGAAAAAGACCGAGGTGCAGACAGGCGGCTTCAGCAAAG

AGTCTATCCTGCCCAAGAGGAACAGCGATAAGCTGATCGC

CAGAAAGAAGGACTGGGACCCTAAGAAGTACGGCGGCTTC

GACAGCCCCACCGTGGCCTATTCTGTGCTGGTGGTGGCCA

AAGTGGAAAAGGGCAAGTCCAAGAAACTGAAGAGTGTGAA

AGAGCTGCTGGGGATCACCATCATGGAAAGAAGCAGCTTC

GAGAAGAATCCCATCGACTTTCTGGAAGCCAAGGGCTACA

AAGAAGTGAAAAAGGACCTGATCATCAAGCTGCCTAAGTA

CTCCCTGTTCGAGCTGGAAAACGGCCGGAAGAGAATGCTG

GCCTCTGCCGGCGAACTGCAGAAGGGAAACGAACTGGCCC

TGCCCTCCAAATATGTGAACTTCCTGTACCTGGCCAGCCA

CTATGAGAAGCTGAAGGGCTCCCCCGAGGATAATGAGCAG

AAACAGCTGTTTGTGGAACAGCACAAGCACTACCTGGACG

AGATCATCGAGCAGATCAGCGAGTTCTCCAAGAGAGTGAT

CCTGGCCGACGCTAATCTGGACAAAGTGCTGTCCGCCTAC

AACAAGCACCGGGATAAGCCCATCAGAGAGCAGGCCGAGA

ATATCATCCACCTGTTTACCCTGACCAATCTGGGAGCCCC

TGCCGCCTTCAAGTACTTTGACACCACCATCGACCGGAAG

AGGTACACCAGCACCAAAGAGGTGCTGGACGCCACCCTGA

TCCACCAGAGCATCACCGGCCTGTACGAGACACGGATCGA

CCTGTCTCAGCTGGGAGGTGAC

Cas9 TadAins 1068
MDKKYSIGLAIGTNSVGWAVITDEYKVPSKKFKVLGNTDR

HSIKKNLIGALLFDSGETAEATRLKRTARRRYTRRKNRIC

-continued

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIFILGELHAILRRQEDFYPFLKDNREK

IEKILTFRIPYYVGPLARGNSRFAWMTRKSEETITPWNFE

EVVDKGASAQSFIERMTNFDKNLPNEKVLPKHSLLYEYFT

VYNELTKVKYVTEGMRKPAFLSGEQKKAIVDLLFKTNRKV

TVKQLKEDYFKKIECFDSVETSGVEDRFNASLGTYHDLLK

IIKDKDFLDNEENEDILEDIVLTLTLFEDREMIEERLKTY

AHLFDDKVMKQLKRRRYTGWGRLSRKLINGIRDKQSGKTI

LDFLKSDGFANRNFMQLIHDDSLTFKEDIQKAQVSGQGDS

LHEHIANLAGSPAIKKGILQTVKVVDELVKVMGRHKPENI

VIEMARENQTTQKGQKNSRERMKRIEEGIKELGSQILKEH

PVENTQLQNEKLYLYYLQNGRDMYVDQELDINRLSDYDVD

HIVPQSFLKDDSIDNKVLTRSDKNRGKSDNVPSEEVVKKM

KNYWRQLLNAKLITQRKFDNLTKAERGGLSELDKAGFIKR

QLVETRQITKHVAQILDSRMNTKYDENDKLIREVKVITLK

SKLVSDFRKDFQFYKVREINNYHHAHDAYLNAVVGTALIK

KYPKLESEFVYGDYKVYDVRKMIAKSEQEIGKATAKYFFY

SNIMNFFKTEITLANGEIRKRPLIETNGEGSSGSETPGTS

ESATPESSGSEVEFSHEWMRHALTLAKRARDEREVPVGAV

LVLNNRVIGEGWNRAIGLHDPTAHAEIMALRQGGLVMQNY

RLIDATLYVTFEPCVMCAGAMIHSRIGRVVFGVRNAKTGA

AGSLMDVLHYPGMNHRVEITEGILADECAALLCYFFRMPR

QVFNAQKKAQSSTDTGEIVWDKGRDFATVRKVLSMPQVNI

VKKTEVQTGGFSKESILPKRNSDKLIARKKDWDPKKYGGF

DSPTVAYSVLVVAKVEKGKSKKLKSVKELLGITIMERSSF

EKNPIDFLEAKGYKEVKKDLIIKLPKYSLFELENGRKRML

ASAGELQKGNELALPSKYVNFLYLASHYEKLKGSPEDNEQ

KQLFVEQHKHYLDEIIEQISEFSKRVILADANLDKVLSAY

NKHRDKPIREQAENIIHLFTLTNLGAPAAFKYFDTTIDRK

RYTSTKEVLDATLIHQSITGLYETRIDLSQLGGD

IB3E006_Cas9: Cas9 TadAins 1247
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

-continued

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

-continued

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGCGGAAGATGATCGCCAAGAGCGAGCA

GGAAATCGGCAAGGCTACCGCCAAGTACTTCTTCTACAGC

AACATCATGAACTTTTTCAAGACCGAGATTACCCTGGCCA

ACGGCGAGATCCGGAAGCGGCCTCTGATCGAGACAAACGG

CGAAACCGGGGAGATCGTGTGGGATAAGGGCCGGGATTTT

GCCACCGTGCGCGGAAAGTGCTGAGCATGCCCCAAGTGAATA

TCGTGAAAAAGACCGAGGTGCAGACAGGCGGCTTCAGCAA

AGAGTCTATCCTGCCCAAGAGGAACAGCGATAAGCTGATC

-continued

GCCAGAAAGAAGGACTGGGACCCTAAGAAGTACGGCGGCT

TCGACAGCCCCACCGTGGCCTATTCTGTGCTGGTGGTGGC

CAAAGTGGAAAAGGGCAAGTCCAAGAAACTGAAGAGTGTG

AAAGAGCTGCTGGGGATCACCATCATGGAAAGAAGCAGCT

TCGAGAAGAATCCCATCGACTTTCTGGAAGCCAAGGGCTA

CAAAGAAGTGAAAAAGGACCTGATCATCAAGCTGCCTAAG

TACTCCCTGTTCGAGCTGGAAAACGGCCGGAAGAGAATGC

TGGCCTCTGCCGGCGA

ACTGCAGAAGGGAAACGAACTGGCCCTGCCCTCCAAATAT

GTGAACTTCCTGTACCTGGCCAGCCACTATGAGAAGCTGA

AGGGCGGTTCTAGCGGCAGCGAGACTCCCGGGACCTCAGA

GTCCGCCACACCCGAAAGTTCTGGTTCCGAAGTCGAGTTT

TCCCATGAGTACTGGATGAGACACGCATTGACTCTCGCAA

AGAGGGCTCGAGATGAACGCGAGGTGCCCGTGGGGGGCAGT

ACTCGTGCTCAACAATCGCGTAATCGGCGAAGGTTGGAAT

AGGGCAATCGGACTCCACGACCCCACTGCACATGCGGAAA

TCATGGCCCTTCGACAGGGAGGGCTTGTGATGCAGAATTA

TCGACTTATCGATGCGACGCTGTACGTCACGTTTGAACCT

TGCGTAATGTGCGCGGGAGCTATGATTCACTCCCGCATTG

GACGAGTTGTATTCGGTGTTCGCAACGCCAAGACGGGTGC

CGCAGGTTCACTGATGGACGTGCTGCATTACCCAGGCATG

AACCACCGGGTAGAAATCACAGAAGGCATATTGGCGGACG

AATGTGCGGCGCTGTTGTGTTACTTTTTTCGCATGCCCAG

GCAGGTCTTTAACGCCCAGAAAAAAGCACAATCCTCTACT

GACTCCCCCGAGGATAATGAGCAGAAACAGCTGTTTGTGG

AACAGCACAAGCACTACCTGGACGAGATCATCGAGCAGAT

CAGCGAGTTCTCCAAGAGAGTGATCCTGGCCGACGCTAAT

CTGGACAAAGTGCTGTCCGCCTACAACAAGCACCGGGATA

AGCCCATCAGAGAGCAGGCCGAGAATATCATCCACCTGTT

TACCCTGACCAATCTGGGAGCCCCTGCCGCCTTCAAGTAC

TTTGACACCACCATCGACCGGAAGAGGTACACCAGCACCA

AAGAGGTGCTGGACGCCACCCTGATCCACCAGAGCATCAC

CGGCCTGTACGAGACACGGATCGACCTGTCTCAGCTGGGA

GGTGAC

Cas9 TadAins 1247
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

-continued

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSQILKEHP

VENTQLQNEKLYLYYLQNGRDMYVDQELDINRLSDYDVDH

IVPQSFLKDDSIDNKVLTRSDKNRGKSDNVPSEEVVKKMK

NYWRQLLNAKLITQRKFDNLTKAERGGLSELDKAGFIKRQ

LVETRQITKHVAQILDSRMNTKYDENDKLIREVKVITLKS

KLVSDFRKDFQFYKVREINNYHHAHDAYLNAVVGTALIKK

YPKLESEFVYGDYKVYDVRKMIAKSEQEIGKATAKYFFYS

NIMNFFKTEITLANGEIRKRPLIETNGETGEIVWDKGRDF

ATVRKVLSMPQVNIVKKTEVQTGGFSKESILPKRNSDKLI

ARKKDWDPKKYGGFDSPTVAYSVLVVAKVEKGKSKKLKSV

KELLGITIMERSSFEKNPIDFLEAKGYKEVKKDLIIKLPK

YSLFELENGRKRMLASAGELQKGNELALPSKYVNFLYLAS

HYEKLKGGSSGSETPGTSESATPESSGSEVEFSHEYWMRH

ALTLAKRARDEREVPVGAVLVLNNRVIGEGWNRAIGLHDP

TAHAEIMALRQGGLVMQNYRLIDATLYVTFEPCVMCAGAM

IHSRIGRVVFGVRNAKTGAAGSLMDVLHYPGMNEIRVEIT

EGILADECAALLCYFFRMPRQVFNAQKKAQSSTDSPEDNE

QKQLFVEQHKHYLDEIIEQISEFSKRVILADANLDKVLSA

YNKHRDKPIREQAENIIHLFTLTNLGAPAAFKYFDTTIDR

KRYTSTKEVLDATLIHQSITGLYETRIDLSQLGGD

IB3E007_Cas9: Cas9 TadAins 1054
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

-continued

```
ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA
```

-continued

```
GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGGAAGATGATCGCCAAGAGCGAGCA

GGAAATCGGCAAGGCTACCGCCAAGTACTTCTTCTACAGC

AACATCATGAACTTTTTCAAGACCGAGATTACCCTGGCCA

ACGGTTCTAGCGGCAGCGAGACTCCCGGGACCTCAGAGTC

CGCCACACCCGAAAGTTCTGGTTCCGAAGTCGAGTTTTCC

CATGAGTACTGGATGAGACACGCATTGACTCTCGCAAAGA

GGGCTCGAGATGAACGCGAGGTGCCCGTGGGGGCAGTACT

CGTGCTCAACAATCGCGTAATCGGCGAAGGTTGGAATAGG

GCAATCGGACTCCACGACCCCACTGCACATGCGGAAATCA

TGGCCCTTCGACAGGGAGGGCTTGTGATGCAGAATTATCG

ACTTATCGATGCGACGCTGTACGTCACGTTTGAACCTTGC

GTAATGTGCGCGGGAGCTATGATTCACTCCCGCATTGGAC
```

-continued

```
GAGTTGTATTCGGTGTTCGCAACGCCAAGACGGGTGCCGC

AGGTTCACTGATGGACGTGCTGCATTACCCAGGCATGAAC

CACCGGGTAGAAATCACAGAAGGCATATTGGCGGACGAAT

GTGCGGCGCTGTTGTGTTACTTTTTTCGCATGCCCAGGCA

GGTCTTTAACGCCCAGAAAAAAGCACAATCCTCTACTGAC

GGCGAGATCCGGAAGCGGCCTCTGATCGAGACAAACGGCG

AAACCGGGGAGATCGTGTGGGATAAGGGCCGGGATTTTGC

CACCGTGCGGAAAGTGCTGAGCATGCCCCAAGTGAATATC

GTGAAAAAGACCGAGGTGCAGACAGGCGGCTTCAGCAAAG

AGTCTATCCTGCCCAAGAGGAACAGCGATAAGCTGATCGC

CAGAAAGAAGGACTGGGACCCTAAGAAGTACGGCGGCTTC

GACAGCCCCACCGTGGCCTATTCTGTGCTGGTGGTGGCCA

AAGTGGAAAAGGGCAAGTCCAAGAAACTGAAGAGTGTGAA

AGAGCTGCTGGGGATCACCATCATGGAAAGAAGCAGCTTC

GAGAAGAATCCCATCGACTTTCTGGAAGCCAAGGGCTACA

AAGAAGTGAAAAAGGACCTGATCATCAAGCTGCCTAAGTA

CTCCCTGTTCGAGCTGGAAAACGGCCGGAAGAGAATGCTG

GCCTCTGCCGGCGAACTGCAGAAGGGAAACGAACTGGCCC

TGCCCTCCAAATATGTGAACTTCCTGTACCTGGCCAGCCA

CTATGAGAAGCTGAAGGGCTCCCCCGAGGATAATGAGCAG

AAACAGCTGTTTGTGGAACAGCACAAGCACTACCTGGACG

AGATCATCGAGCAGATCAGCGAGTTCTCCAAGAGAGTGAT

CCTGGCCGACGCTAATCTGGACAAAGTGCTGTCCGCCTAC

AACAAGCACCGGGATAAGCCCATCAGAGAGCAGGCCGAGA

ATATCATCCACCTGTTTACCCTGACCAATCTGGGAGCCCC

TGCCGCCTTCAAGTACTTTGACACCACCATCGACCGGAAG

AGGTACACCAGCACCAAAGAGGTGCTGGACGCCACCCTGA

TCCACCAGAGCATCACCGGCCTGTACGAGACACGGATCGA

CCTGTCTCAGCTGGAGGTGAC
```

Cas9 TadAins 1054
```
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI
```

-continued

```
EKILTFRIPYYVGPLARGNSRFAWMTRKSEETITPWNFEE

VVDKGASAQSFIERNITNFDKNLPNEKVLPKHSLLYEYFT

VYNELTKVKYVTEGMRKPAFLSGEQKKAIVDLLFKTNRKV

TVKQLKEDYFKKIECFDSVETSGVEDRFNASLGTYHDLLK

IIKDKDFLDNEENEDILEDIVLTLTLFEDREMIEERLKTY

AHLFDDKVMKQLKRRRYTGWGRLSRKLINGIRDKQSGKTI

LDFLKSDGFANRNFMQLIHDDSLTFKEDIQKAQVSGQGDS

LHEHIANLAGSPAIKKGILQTVKVVDELVKVMGRHKPENI

VIEMARENQTTQKGQKNSRERMKRIEEGIKELGSQILKEH

PVENTQLQNEKLYLYYLQNGRDMYVDQELDINRLSDYDVD

HIVPQSFLKDDSIDNKVLTRSDKNRGKSDNVPSEEVVKKM

KNYWRQLLNAKLITQRKFDNLTKAERGGLSELDKAGFIKR

QLVETRQITKHVAQILDSRMNTKYDENDKLIREVKVITLK

SKLVSDFRKDFQFYKVREINNYHHAHDAYLNAVVGTALIK

KYPKLESEFVYGDYKVYDVRKMIAKSEQEIGKATAKYFFY

SNIMNFFKTEITLANGSSGSETPGTSESATPESSGSEVEF

SHEYWMRHALTLAKRARDEREVPVGAVLVLNNRVIGEGWN

RAIGLHDPTAHAEIMALRQGGLVMQNYRLIDATLYVTFEP

CVMCAGAMIHSRIGRVVFGVRNAKTGAAGSLMDVLHYPGM

NHRVEITEGILADECAALLCYFFRMPRQVFNAQKKAQSST

DGEIRKRPLIETNGETGEIVWDKGRDFATVRKVLSMPQVN

IVKKTEVQTGGFSKESILPKRNSDKLIARKKDWDPKKYGG

FDSPTVAYSVLVVAKVEKGKSKKLKSVKELLGITIMERSS

FEKNPIDFLEAKGYKEVKKDLIIKLPKYSLFELENGRKRM

LASAGELQKGNELALPSKYVNFLYLASHYEKLKGSPEDNE

QKQLFVEQHKHYLDEIIEQISEFSKRVILADANLDKVLSA

YNKHRDKPIREQAENIIHLFTLTNLGAPAAFKYFDTTIDR

KRYTSTKEVLDATLIHQSITGLYETRIDLSQLGGD
```

IB3E008_Cas9: Cas9 TadAins 1026
```
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC
```

237

-continued

```
ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA
```

238

-continued

```
TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGCGAAGATGATCGCCAAGAGCGAGGG

TTCTAGCGGCAGCGAGACTCCCGGGACCTCAGAGTCCGCC

ACACCCGAAAGTTCTGGTTCCGAAGTCGAGTTTTCCCATG

AGTACTGGATGAGACACGCATTGACTCTCGCAAAGAGGGC

TCGAGATGAACGCGAGGTGCCCGTGGGGGCAGTACTCGTG

CTCAACAATCGCGTAATCGGCGAAGGTTGGAATAGGGCAA

TCGGACTCCACGACCCCACTGCACATGCGGAAATCATGGC

CCTTCGACAGGGAGGGCTTGTGATGCAGAATTATCGACTT

ATCGATGCGACGCTGTACGTCACGTTTGAACCTTGCGTAA

TGTGCGCGGGAGCTATGATTCACTCCCGCATTGGACGAGT

TGTATTCGGTGTTCGCAACGCCAAGACGGGTGCCGCAGGT

TCACTGATGGACGTGCTGCATTACCCAGGCATGAACCACC

GGGTAGAAATCACAGAAGGCATATTGGCGGACGAATGTGC

GGCGCTGTTGTGTTACTTTTTTCGCATGCCCAGGCAGGTC

TTTAACGCCCAGAAAAAAGCACAATCCTCTACTGACCAGG

AAATCGGCAAGGCTACCGCCAAGTACTTCTTCTACAGCAA

CATCATGAACTTTTTTCAAGACCGAGATTACCCTGGCCAAC
```

-continued

GGCGAGATCCGGAAGCGGCCTCTGATCGAGACAAACGGCG

AAACCGGGGAGATCGTGTGGGATAAGGGCCGGGATTTTGC

CACCGTGCGGAAAGTGCTGAGCATGCCCCAAGTGAATATC

GTGAAAAAGACCGAGGTGCAGACAGGCGGCTTCAGCAAAG

AGTCTATCCTGCCCAAGAGGAACAGCGATAAGCTGATCGC

CAGAAAGAAGGACTGGGACCCTAAGAAGTACGGCGGCTTC

GACAGCCCCACCGTGGCCTATTCTGTGCTGGTGGTGGCCA

AAGTGGAAAAGGGCAAGTCCAAGAAACTGAAGAGTGTGAA

AGAGCTGCTGGGGATCACCATCATGGAAAGAAGCAGCTTC

GAGAAGAATCCCATCGACTTTCTGGAAGCCAAGGGCTACA

AAGAAGTGAAAAAGGACCTGATCATCAAGCTGCCTAAGTA

CTCCCTGTTCGAGCTGGAAAACGGCCGGAAGAGAATGCTG

GCCTCTGCCGGCGAACTGCAGAAGGGAAACGAACTGGCCC

TGCCCTCCAAATATGTGAACTTCCTGTACCTGGCCAGCCA

CTATGAGAAGCTGAAGGGCTCCCCCGAGGATAATGAGCAG

AAACAGCTGTTTGTGGAACAGCACAAGCACTACCTGGACG

AGATCATCGAGCAGATCAGCGAGTTCTCCAAGAGAGTGAT

CCTGGCCGACGCTAATCTGGACAAAGTGCTGTCCGCCTAC

AACAAGCACCGGGATAAGCCCATCAGAGAGCAGGCCGAGA

ATATCATCCACCTGTTTACCCTGACCAATCTGGGAGCCCC

TGCCGCCTTCAAGTACTTTGACACCACCATCGACCGGAAG

AGGTACACCAGCACCAAAGAGGTGCTGGACGCCACCCTGA

TCCACCAGAGCATCACCGGCCTGTACGAGACACGGATCGA

CCTGTCTCAGCTGGGAGGTGAC

Cas9 TadAins 1026
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMINFDKNLPNEKVLPKHSLLYEYFTV

YNELTKVKYVTEGMRKPAELSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

-continued

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSQILKEHP

VENTQLQNEKLYLYYLQNGRDMYVDQELDINRLSDYDVDH

IVPQSFLKDDSIDNKVLTRSDKNRGKSDNVPSEEVVKKMK

NYWRQLLNAKLITQRKFDNLTKAERGGLSELDKAGFIKRQ

LVETRQITKHVAQILDSRMNTKYDENDKLIREVKVITLKS

KLVSDFRKDFQFYKVREINNYHHAHDAYLNAVVGTALIKK

YPKLESEFVYGDYKVYDVRKMIAKSEGSSGSETPGTSESA

TPESSGSEVEFSHEYWMRHALTLAKRARDEREVPVGAVLV

LNNRVIGEGWNRAIGLHDPTAHAEIMALRQGGLVMQNYRU

DATLYVTFEPCVMCAGAMIHSRIGRVVFGVRNAKTGAAGS

LMDVLHYPGMNHRVEITEGILADECAALLCYFFRMPRQVF

NAQKKAQSSTDQEIGKATAKYFFYSNIMNFFKTEITLANG

EIRKRPLIETNGETGEIVWDKGRDFATVRKVLSMPQVNIV

KKTEVQTGGFSKESILPKRNSDKLIARKKDWDPKKYGGFD

SPTVAYSVLVVAKVEKGKSKKLKSVKELLGITIMERSSFE

KNPIDFLEAKGYKEVKKDLIIKLPKYSLFELENGRKRMLA

SAGELQKGNELALPSKYVNFLYLASHYEKLKGSPEDNEQK

QLFVEQHKHYLDEIIEQISEFSKRVILADANLDKVLSAYN

KHRDKPIREQAENIITILFTLTNLGAPAAFKYFDTTIDRK

RYTSTKEVLDATLIHQSITGLYETRIDLSQLGGD

IBE009_Cas9: Cas9 TadAins 768
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

-continued

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGGGGTTCTAGCGGCAGCG

AGACTCCCGGGACCTCAGAGTCCGCCACACCCGAAAGTTC

TGGTTCCGAAGTCGAGTTTTCCCATGAGTACTGGATGAGA

CACGCATTGACTCTCGCAAAGAGGGCTCGAGATGAACGCG

AGGTGCCCGTGGGGGCAGTACTCGTGCTCAACAATCGCGT

AATCGGCGAAGGTTGGAATAGGGCAATCGGACTCCACGAC

CCCACTGCACATGCGGAAATCATGGCCCTTCGACAGGGAG

GGCTTGTGATGCAGAATTATCGACTTATCGATGCGACGCT

GTACGTCACGTTTGAACCTTGCGTAATGTGCGCGGGAGCT

ATGATTCACTCCCGCATTGGACGAGTTGTATTCGGTGTTC

GCAACGCCAAGACGGGTGCCGCAGGTTCACTGATGGACGT

GCTGCATTACCCAGGCATGAACCACCGGGTAGAAATCACA

GAAGGCATATTGGCGGACGAATGTGCGGCGCTGTTGTGTT

ACTTTTTTCGCATGCCCAGGACCACCCAGAAGGGACAGAA

GAACAGCCGCGAGAGAATGAAGCGGATCGAAGAGGGCATC

AAAGAGCTGGGCAGCCAGATCCTGAAAGAACACCCCGTGG

AAAACACCCAGCTGCAGAACGAGAAGCTGTACCTGTACTA

CCTGCAGAATGGGCGGGATATGTACGTGGACCAGGAACTG

GACATCAACCGGCTGTCCGACTACGATGTGGACCATATCG

TGCCTCAGAGCTTTCTGAAGGACGACTCCATCGACAACAA

GGTGCTGACCAGAAGCGACAAGAACCGGGGCAAGAGCGAC

AACGTGCCCTCCGAAGAGGTCGTGAAGAAGATGAAGAACT

ACTGGCGGCAGCTGCTGAACGCCAAGCTGATTACCCAGAG

AAAGTTCGACAATCTGACCAAGGCCGAGAGAGGCGGCCTG

AGCGAACTGGATAAGGCCGGCTTCATCAAGAGACAGCTGG

TGGAAACCCGGCAGATCACAAAGCACGTGGCACAGATCCT

GGACTCCCGGATGAACACTAAGTACGACGAGAATGACAAG

CTGATCCGGGAAGTGAAAGTGATCACCCTGAAGTCCAAGC

TGGTGTCCGATTTCCGGAAGGATTTCCAGTTTTACAAAGT

GCGCGAGATCAACAACTACCACCACGCCCACGACGCCTAC

CTGAACGCCGTCGTGGGAACCGCCCTGATCAAAAAGTACC

CTAAGCTGGAAAGCGAGTTCGTGTACGGCGACTACAAGGT

GTACGACGTGCGGAAGATGATCGCCAAGAGCGAGCAGGAA

ATCGGCAAGGCTACCGCCAAGTACTTCTTCTACAGCAACA

TCATGAACTTTTTCAAGACCGAGATTACCCTGGCCAACGG

CGAGATCCGGAAGCGGCCTCTGATCGAGACAAACGGCGAA

ACCGGGGAGATCGTGTGGGATAAGGGCCGGGATTTTGCCA

CCGTGCGGAAAGTGCTGAGCATGCCCCAAGTGAATATCGT

GAAAAAGACCGAGGTGCAGACAGGCGGCTTCAGCAAAGAG

TCTATCCTGCCCAAGAGGAACAGCGATAAGCTGATCGCCA

GAAAGAAGGACTGGGACCCTAAGAAGTACGGCGGCTTCGA

-continued

```
CAGCCCCACCGTGGCCTATTCTGTGCTGGTGGTGGCCAAA

GTGGAAAAGGGCAAGTCCAAGAAACTGAAGAGTGTGAAAG

AGCTGCTGGGGATCACCATCATGGAAAGAAGCAGCTTCGA

GAAGAATCCCATCGACTTTCTGGAAGCCAAGGGCTACAAA

GAAGTGAAAAAGGACCTGATCATCAAGCTGCCTAAGTACT

CCCTGTTCGAGCTGGAAAACGGCCGGAAGAGAATGCTGGC

CTCTGCCGGCGAACTGCAGAAGGGAAACGAACTGGCCCTG

CCCTCCAAATATGTGAACTTCCTGTACCTGGCCAGCCACT

ATGAGAAGCTGAAGGGCTCCCCCGAGGATAATGAGCAGAA

ACAGCTGTTTGTGGAACAGCACAAGCACTACCTGGACGAG

ATCATCGAGCAGATCAGCGAGTTCTCCAAGAGAGTGATCC

TGGCCGACGCTAATCTGGACAAAGTGCTGTCCGCCTACAA

CAAGCACCGGGATAAGCCCATCAGAGAGCAGGCCGAGAAT

ATCATCCACCTGTTTACCCTGACCAATCTGGGAGCCCCTG

CCGCCTTCAAGTACTTTGACACCACCATCGACCGGAAGAG

GTACACCAGCACCAAAGAGGTGCTGGACGCCCACCCTGATC

CACCAGAGCATCACCGGCCTGTACGAGACACGGATCGACC

TGTCTCAGCTGGGAGGTGAC
```

Cas9 TadAins 768
```
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKIINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQGSSGSETPGTSESATPESSGSEVEFSHEYWMR

HALTLAKRARDEREVPVGAVLVLNNRVIGEGWNRAIGLHD

PTAHAEIMALRQGGLVMQNYRUDATLYVTFEPCVNICAGA
```

-continued

```
MIHSRIGRVVFGVRNAKTGAAGSLMDVLHYPGMNHRVEIT

EGILADECAALLCYFFRMPRTTQKGQKNSRERMKRIEEGI

KELGSQILKEHPVENTQLQNEKLYLYYLQNGRDMYVDQEL

DINRLSDYDVDHIVPQSFLKDDSIDNKVLTRSDKNRGKSD

NVPSEEVVKKMKNYWRQLLNAKLITQRKFDNLTKAERGGL

SELDKAGFIKRQLVETRQITKHVAQILDSRMNTKYDENDK

LIREVKVITLKSKLVSDFRKDFQFYKVREINNYHHAHDAY

LNAVVGTALIKKYPKLESEFVYGDYKVYDVRKMIAKSEQE

IGKATAKYFFYSNIMNFFKTEITLANGEIRKRPLIETNGE

TGEIVWDKGRDFATVRKVLSMPQVNIVKKTEVQTGGFSKE

SILPKRNSDKLIARKKDWDPKKYGGFDSPTVAYSVLVVAK

VEKGKSKKLKSVKELLGITIMERSSFEKNPIDFLEAKGYK

EVKKDLIIKLPKYSLFELENGRKRMLASAGELQKGNELAL

PSKYVNFLYLASHYEKLKGSPEDNEQKQLFVEQHKHYLDE

IIEQISEFSKRVILADANLDKVLSAYNKHRDKPIREQAEN

IIHLFTLTNLGAPAAFKYFDTTIDRKRYTSTKEVLDATLI

HQSITGLYETRIDLSQLGGD
```

IBE020_delt: delta HNH TadA 792
```
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG
```

-continued

```
AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCTCCGAAGTCGAGTTTTCCCATGAG

TACTGGATGAGACACGCATTGACTCTCGCAAAGAGGGCTC

GAGATGAACGCGAGGTGCCCGTGGGGGCAGTACTCGTGCT

CAACAATCGCGTAATCGGCGAAGGTTGGAATAGGGCAATC
```

-continued

```
GGACTCCACGACCCCACTGCACATGCGGAAATCATGGCCC

TTCGACAGGGAGGGCTTGTGATGCAGAATTATCGACTTAT

CGATGCGACGCTGTACGTCACGTTTGAACCTTGCGTAATG

TGCGCGGGAGCTATGATTCACTCCCGCATTGGACGAGTTG

TATTCGGTGTTCGCAACGCCAAGACGGGTGCCGCAGGTTC

ACTGATGGACGTGCTGCATTACCCAGGCATGAACCACCGG

GTAGAAATCACAGAAGGCATATTGGCGGACGAATGTGCGG

CGCTGTTGTGTTACTTTTTTCGCATGCCCAGGCAGGTCTT

TAACGCCCAGAAAAAAGCACAATCCTCTACTGACGGCGGC

CTGAGCGAACTGGATAAGGCCGGCTTCATCAAGAGACAGC

TGGTGGAAACCCGGCAGATCACAAAGCACGTGGCACAGAT

CCTGGACTCCCGGATGAACACTAAGTACGACGAGAATGAC

AAGCTGATCCGGGAAGTGAAAGTGATCACCCTGAAGTCCA

AGCTGGTGTCCGATTTCCGGAAGGATTTCCAGTTTTACAA

AGTGCGCGAGATCAACAACTACCACCACGCCCACGACGCC

TACCTGAACGCCGTCGTGGGAACCGCCCTGATCAAAAAGT

ACCCTAAGCTGGAAAGCGAGTTCGTGTACGGCGACTACAA

GGTGTACGACGTGCGGAAGATGATCGCCAAGAGCGAGCAG

GAAATCGGCAAGGCTACCGCCAAGTACTTCTTCTACAGCA

ACATCATGAACTTTTTTCAAGACCGAGATTACCCTGGCCAA

CGGCGAGATCCGGAAGCGGCCTCTGATCGAGACAAACGGC

GAAACCGGGGAGATCGTGTGGGATAAGGGCCGGGATTTTG

CCACCGTGCGGAAAGTGCTGAGCATGCCCCAAGTGAATAT

CGTGAAAAAGACCGAGGTGCAGACAGGCGGCTTCAGCAAA

GAGTCTATCCTGCCCAAGAGGAACAGCGATAAGCTGATCG

CCAGAAAGAAGGACTGGGACCCTAAGAAGTACGGCGGCTT

CGACAGCCCCACCGTGGCCTATTCTGTGCTGGTGGTGGCC

AAAGTGGAAAAGGGCAAGTCCAAGAAACTGAAGAGTGTGA

AAGAGCTGCTGGGGATCACCATCATGGAAAGAAGCAGCTT

CGAGAAGAATCCCATCGACTTTCTGGAAGCCAAGGGCTAC

AAAGAAGTGAAAAAGGACCTGATCATCAAGCTGCCTAAGT

ACTCCCTGTTCGAGCTGGAAAACGGCCGGAAGAGAATGCT

GGCCTCTGCCGGCGAACTGCAGAAGGGAAACGAACTGGCC

CTGCCCTCCAAATATGTGAACTTCCTGTACCTGGCCAGCC

ACTATGAGAAGCTGAAGGGCTCCCCCGAGGATAATGAGCA

GAAACAGCTGTTTGTGGAACAGCACAAGCACTACCTGGAC

GAGATCATCGAGCAGATCAGCGAGTTCTCCAAGAGAGTGA

TCCTGGCCGACGCTAATCTGGACAAAGTGCTGTCCGCCTA

CAACAAGCACCGGGATAAGCCCATCAGAGAGCAGGCCGAG

AATATCATCCACCTGTTTACCCTGACCAATCTGGGAGCCC

CTGCCGCCTTCAAGTACTTTGACACCACCATCGACCGGAA
```

-continued

GAGGTACACCAGCACCAAAGAGGTGCTGGACGCCACCCTG

ATCCACCAGAGCATCACCGGCCTGTACGAGACACGGATCG

ACCTGTCTCAGCTGGGAGGTGAC delta HNH TadA 792
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMINFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSEVEFSHE

YWMRHALTLAKRARDEREVPVGAVLVLNNRVIGEGWNRAI

GLHDPTAHAEIMALRQGGLVMQNYRLIDATLYVTFEPCVM

CAGAMIHSRIGRVVFGVRNAKTGAAGSLMDVLHYPGMNHR

VEITEGILADECAALLCYFFRMPRQVFNAQKKAQSSTDGG

LSELDKAGFIKRQLVETRQITKHVAQILDSRMNTKYDEND

KLIREVKVITLKSKLVSDFRKDFQFYKVREINNYHHAHDA

YLNAVVGTALIKKYPKLESEFVYGDYKVYDVRKMIAKSEQ

EIGKATAKYFFYSNIMNFFKTEITLANGEIRKRPLIETNG

ETGEIVWDKGRDFATVRKVLSMPQVNIVKKTEVQTGGFSK

ESILPKRNSDKLIARKKDWDPKKYGGFDSPTVAYSVLVVA

KVEKGKSKKLKSVKELLGITIMERSSFEKNPIDFLEAKGY

KEVKKDLIIKLPKYSLFELENGRKRMLASAGELQKGNELA

LPSKYVNFLYLASHYEKLKGSPEDNEQKQLFVEQHKHYLD

EIIEQISEFSKRVILADANLDKVLSAYNKHRDKPIREQAE

-continued
NIIHLFTLTNLGAPAAFKYFDTTIDRKRYTSTKEVLDATL

IHQSITGLYETRIDLSQLGGD

IBE021_N-te: N-term fusion single
TadA helix truncated 165-end
ATGTCCGAAGTCGAGTTTCCCATGAGTACTGGATGAGAC

ACGCATTGACTCTCGCAAAGAGGGCTCGAGATGAACGCGA

GGTGCCCGTGGGGGCAGTACTCGTGCTCAACAATCGCGTA

ATCGGCGAAGGTTGGAATAGGGCAATCGGACTCCACGACC

CCACTGCACATGCGGAAATCATGGCCCTTCGACAGGGAGG

GCTTGTGATGCAGAATTATCGACTTATCGATGCGACGCTG

TACGTCACGTTTGAACCTTGCGTAATGTGCGCGGGAGCTA

TGATTCACTCCCGCATTGGACGAGTTGTATTCGGTGTTCG

CAACGCCAAGACGGGTGCCGCAGGTTCACTGATGGACGTG

CTGCATTACCCAGGCATGAACCACCGGGTAGAAATCACAG

AAGGCATATTGGCGGACGAATGTGCGGCGCTGTTGTGTTA

CTTTTTTCGCATGCCCAGGTCTGGTGGTTCTTCTGGTGGT

TCTAGCGGCAGCGAGACTCCCGGGACCTCAGAGTCCGCCA

CACCCGAAAGTTCTGGTGGTTCTTCTGGTGGTTCTGACAA

GAAGTACAGCATCGGCCTGGCCATCGGCACCAACTCTGTG

GGCTGGGCCGTGATCACCGACGAGTACAAGGTGCCCAGCA

AGAAATTCAAGGTGCTGGGCAACACCGACCGGCACAGCAT

CAAGAAGAACCTGATCGGAGCCCTGCTGTTCGACAGCGGC

GAAACAGCCGAGGCCACCCGGCTGAAGAGAACCGCCAGAA

GAAGATACACCAGACGGAAGAACCGGATCTGCTATCTGCA

AGAGATCTTCAGCAACGAGATGGCCAAGGTGGACGACAGC

TTCTTCCACAGACTGGAAGAGTCCTTCCTGGTGGAAGAGG

ATAAGAAGCACGAGCGGCACCCCATCTTCGGCAACATCGT

GGACGAGGTGGCCTACCACGAGAAGTACCCCACCATCTAC

CACCTGAGAAAGAAACTGGTGGACAGCACCGACAAGGCCG

ACCTGCGGCTGATCTATCTGGCCCTGGCCCACATGATCAA

GTTCCGGGGCCACTTCCTGATCGAGGGCGACCTGAACCCC

GACAACAGCGACGTGGACAAGCTGTTCATCCAGCTGGTGC

AGACCTACAACCAGCTGTTCGAGGAAAACCCCATCAACGC

CAGCGGCGTGGACGCCAAGGCCATCCTGTCTGCCAGACTG

AGCAAGAGCAGACGGCTGGAAAATCTGATCGCCCAGCTGC

CCGGCGAGAAGAAGAATGGCCTGTTCGGAAACCTGATTGC

CCTGAGCCTGGGCCTGACCCCCAACTTCAAGAGCAACTTC

GACCTGGCCGAGGATGCCAAACTGCAGCTGAGCAAGGACA

CCTACGACGACGACCTGGACAACCTGCTGGCCCAGATCGG

CGACCAGTACGCCGACCTGTTTCTGGCCGCCAAGAACCTG

TCCGACGCCATCCTGCTGAGCGACATCCTGAGAGTGAACA

CCGAGATCACCAAGGCCCCCCTGAGCGCCTCTATGATCAA

-continued

GAGATACGACGAGCACCACCAGGACCTGACCCTGCTGAAA

GCTCTCGTGCGGCAGCAGCTGCCTGAGAAGTACAAAGAGA

TTTTCTTCGACCAGAGCAAGAACGGCTACGCCGGCTACAT

TGACGGCGGAGCCAGCCAGGAAGAGTTCTACAAGTTCATC

AAGCCCATCCTGGAAAAGATGGACGGCACCGAGGAACTGC

TCGTGAAGCTGAACAGAGAGGACCTGCTGCGGAAGCAGCG

GACCTTCGACAACGGCAGCATCCCCCACCAGATCCACCTG

GGAGAGCTGCACGCCATTCTGCGGCGGCAGGAAGATTTTT

ACCCATTCCTGAAGGACAACCGGGAAAAGATCGAGAAGAT

CCTGACCTTCCGCATCCCCTACTACGTGGGCCCTCTGGCC

AGGGGAAACAGCAGATTCGCCTGGATGACCAGAAAGAGCG

AGGAAACCATCACCCCCTGGAACTTCGAGGAAGTGGTGGA

CAAGGGCGCTTCCGCCCAGAGCTTCATCGAGCGGATGACC

AACTTCGATAAGAACCTGCCCAACGAGAAGGTGCTGCCCA

AGCACAGCCTGCTGTACGAGTACTTCACCGTGTATAACGA

GCTGACCAAAGTGAAATACGTGACCGAGGGAATGAGAAAG

CCCGCCTTCCTGAGCGGCGAGCAGAAAAAGGCCATCGTGG

ACCTGCTGTTCAAGACCAACCGGAAAGTGACCGTGAAGCA

GCTGAAAGAGGACTACTTCAAGAAAATCGAGTGCTTCGAC

TCCGTGGAAATCTCCGGCGTGGAAGATCGGTTCAACGCCT

CCCTGGGCACATACCACGATCTGCTGAAAATTATCAAGGA

CAAGGACTTCCTGGACAATGAGGAAAACGAGGACATTCTG

GAAGATATCGTGCTGACCCTGACACTGTTTGAGGACAGAG

AGATGATCGAGGAACGGCTGAAAACCTATGCCCACCTGTT

CGACGACAAAGTGATGAAGCAGCTGAAGCGGCGGAGATAC

ACCGGCTGGGGCAGGCTGAGCCGGAAGCTGATCAACGGCA

TCCGGGACAAGCAGTCCGGCAAGACAATCCTGGATTTCCT

GAAGTCCGACGGCTTCGCCAACAGAAACTTCATGCAGCTG

ATCCACGACGACAGCCTGACCTTTAAAGAGGACATCCAGA

AAGCCCAGGTGTCCGGCCAGGGCGATAGCCTGCACGAGCA

CATTGCCAATCTGGCCGGCAGCCCCGCCATTAAGAAGGGC

ATCCTGCAGACAGTGAAGGTGGTGGACGAGCTCGTGAAAG

TGATGGGCCGGCACAAGCCCGAGAACATCGTGATCGAAAT

GGCCAGAGAGAACCAGACCACCCAGAAGGGACAGAAGAAC

AGCCGCGAGAGAATGAAGCGGATCGAAGAGGGCATCAAAG

AGCTGGGCAGCCAGATCCTGAAAGAACACCCCGTGGAAAA

CACCCAGCTGCAGAACGAGAAGCTGTACCTGTACTACCTG

CAGAATGGGCGGGATATGTACGTGGACCAGGAACTGGACA

TCAACCGGCTGTCCGACTACGATGTGGACCATATCGTGCC

TCAGAGCTTTCTGAAGGACGACTCCATCGACAACAAGGTG

CTGACCAGAAGCGACAAGAACCGGGGCAAGAGCGACAACG

TGCCCTCCGAAGAGGTCGTGAAGAAGATGAAGAACTACTG

GCGGCAGCTGCTGAACGCCAAGCTGATTACCCAGAGAAAG

TTCGACAATCTGACCAAGGCCGAGAGAGGCGGCCTGAGCG

AACTGGATAAGGCCGGCTTCATCAAGAGACAGCTGGTGGA

AACCCGGCAGATCACAAAGCACGTGGCACAGATCCTGGAC

TCCCGGATGAACACTAAGTACGACGAGAATGACAAGCTGA

TCCGGGAAGTGAAAGTGATCACCCTGAAGTCCAAGCTGGT

GTCCGATTTCCGGAAGGATTTCCAGTTTTACAAAGTGCGC

GAGATCAACAACTACCACCACGCCCACGACGCCTACCTGA

ACGCCGTCGTGGGAACCGCCCTGATCAAAAAGTACCCTAA

GCTGGAAAGCGAGTTCGTGTACGGCGACTACAAGGTGTAC

GACGTGCGGAAGATGATCGCCAAGAGCGAGCAGGAAATCG

GCAAGGCTACCGCCAAGTACTTCTTCTACAGCAACATCAT

GAACTTTTTCAAGACCGAGATTACCCTGGCCAACGGCGAG

ATCCGGAAGCGGCCTCTGATCGAGACAAACGGCGAAACCG

GGGAGATCGTGTGGGATAAGGGCCGGGATTTTGCCACCGT

GCGGAAAGTGCTGAGCATGCCCCAAGTGAATATCGTGAAA

AAGACCGAGGTGCAGACAGGCGGCTTCAGCAAAGAGTCTA

TCCTGCCCAAGAGGAACAGCGATAAGCTGATCGCCAGAAA

GAAGGACTGGGACCCTAAGAAGTACGGCGGCTTCGACAGC

CCCACCGTGGCCTATTCTGTGCTGGTGGTGGCCAAAGTGG

AAAAGGGCAAGTCCAAGAAACTGAAGAGTGTGAAAGAGCT

GCTGGGGATCACCATCATGGAAAGAAGCAGCTTCGAGAAG

AATCCCATCGACTTTCTGGAAGCCAAGGGCTACAAAGAAG

TGAAAAAGGACCTGATCATCAAGCTGCCTAAGTACTCCCT

GTTCGAGCTGGAAAACGGCCGGAAGAGAATGCTGGCCTCT

GCCGGCGAACTGCAGAAGGGAAACGAACTGGCCCTGCCCT

CCAAATATGTGAACTTCCTGTACCTGGCCAGCCACTATGA

GAAGCTGAAGGGCTCCCCCGAGGATAATGAGCAGAAACAG

CTGTTTGTGGAACAGCACAAGCACTACCTGGACGAGATCA

TCGAGCAGATCAGCGAGTTCTCCAAGAGAGTGATCCTGGC

CGACGCTAATCTGGACAAAGTGCTGTCCGCCTACAACAAG

CACCGGGATAAGCCCATCAGAGAGCAGGCCGAGAATATCA

TCCACCTGTTTACCCTGACCAATCTGGGAGCCCCTGCCGC

CTTCAAGTACTTTGACACCACCATCGACCGGAAGAGGTAC

-continued

```
ACCAGCACCAAAGAGGTGCTGGACGCCACCCTGATCCACC

AGAGCATCACCGGCCTGTACGAGACACGGATCGACCTGTC

TCAGCTGGGAGGTGAC
ME021_N-te: N-term fusion single
TadA helix truncated 165-end
MSEVEFSHEWMRHALTLAKRARDEREVPVGAVLVLNNRVI

GEGWNRAIGLHDPTAHAEIMALRQGGLVMQNYRLIDATLY

VTFEPCVMCAGAMIHSRIGRVVFGVRNAKTGAAGSLMDVL

HYPGMNHRVEITEGILADECAALLCYFFRMPRSGGSSGGS

SGSETPGTSESATPESSGGSSGGSDKKYSIGLAIGTNSVG

WAVITDEYKVPSKKFKVLGNTDRHSIKKNLIGALLFDSGE

TAEATRLKRTARRRYTRRKNRICYLQEIFSNEMAKVDDSF

FHRLEESFLVEEDKKHERHPIFGNIVDEVAYHEKYPTIYH

LRKKLVDSTDKADLRLIYLALAHMIKFRGHFLIEGDLNPD

NSDVDKLFIQLVQTYNQLFEENPINASGVDAKAILSARLS

KSRRLENLIAQLPGEKKNGLFGNLIALSLGLTPNFKSNFD

LAEDAKLQLSKDTYDDDLDNLLAQIGDQYADLFLAAKNLS

DAILLSDILRVNTEITKAPLSASMIKRYDEHHQDLTLLKA

LVRQQLPEKYKEIFFDQSKNGYAGYIDGGASQEEFYKFIK

PILEKMDGTEELLVKLNREDLLRKQRTFDNGSIPHQIIIL

GELHAILRRQEDFYPFLKDNREKIEKILTFRIPYYVGPLA

RGNSRFAWMTRKSEETITPWNFEEVVDKGASAQSFIERMT

NFDKNLPNEKVLPKHSLLYEYFTVYNELTKVKYVTEGMRK

PAFLSGEQKKAIVDLLFKTNRKVTVKQLKEDYFKKIECED

SVETSGVEDRFNASLGTYHDLLKIIKDKDFLDNEENEDIL

EDIVLTLTLFEDREMIEERLKTYAHLFDDKVMKQLKRRRY

TGWGRLSRKLINGIRDKQSGKTILDFLKSDGFANRNFMQL

IHDDSLTFKEDIQKAQVSGQGDSLHEHIANLAGSPAIKKG

ILQTVKVVDELVKVMGRHKPENIVIEMARENQTTQKGQKN

SRERMKRIEEGIKELGSQILKEHPVENTQLQNEKLYLYYL

QNGRDMYVDQELDINRLSDYDVDHIVPQSFLKDDSIDNKV

LTRSDKNRGKSDNVPSEEVYKKMKNYWRQLLNAKLITQRK

EDNLTKAERGGLSELDKAGFIKRQLVETRQITKHVAQILD

SRMNTKYDENDKLIREVKVITLKSKLVSDFRKDFQFYKYR

EINNYHHAHDAYLNAVVGTALIKKYPKLESEFVYGDYKVY

DVRKMIAKSEQEIGKATAKYFFYSNIMNFFKTEITLANGE

IRKRPLIETNGETGEIVWDKGRDFATVRKVLSMPQVNIVK

KTEVQTGGFSKESILPKRNSDKLIARKKDWDPKKYGGFDS

PTVAYSVLVVAKVEKGKSKKLKSVKELLGITIMERSSFEK

NPIDFLEAKGYKEVKKDLIIKLPKYSLFELENGRKRMLAS

AGELQKGNELALPSKYVNFLYLASHYEKLKGSPEDNEQKQ

LFVEQHKHYLDEIIEQISEFSKRVILADANLDKVLSAYNK
```

-continued

```
HRDKPIREQAENIIFILFTLTNLGAPAAFKYFDTTIDRKR

YTSTKEVLDATLIHQSITGLYETRIDLSQLGGD

IB3E029_ISLA: TadA-CP116ins 1067
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT
```

5

10

15

20

25

30

35

40

45

50

55

60

65

-continued

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGCAAGATGATCGCCAAGAGCGAGCA

GGAAATCGGCAAGGCTACCGCCAAGTACTTCTTCTACAGC

AACATCATGAACTTTTTCAAGACCGAGATTACCCTGGCCA

-continued

ACGGCGAGATCCGGAAGCGGCCTCTGATCGAGACAAACAT

GAACCACCGGGTAGAAATCACAGAAGGCATATTGGCGGAC

GAATGTGCGGCGCTGTTGTGTTACTTTTTTCGCATGCCCA

GGCAGGTCTTTAACGCCCAGAAAAAAGCACAATCCTCTAC

TGACGGTTCTAGCGGCAGCGAGACTCCCGGGACCTCAGAG

TCCGCCACACCCGAAAGTTCTGGTTCCGAAGTCGAGTTTT

CCCATGAGTACTGGATGAGACACGCATTGACTCTCGCAAA

GAGGGCTCGAGATGAACGCGAGGTGCCCGTGGGGGCAGTA

CTCGTGCTCAACAATCGCGTAATCGGCGAAGGTTGGAATA

GGGCAATCGGACTCCACGACCCCACTGCACATGCGGAAAT

CATGGCCCTTCGACAGGGAGGGCTTGTGATGCAGAATTAT

CGACTTATCGATGCGACGCTGTACGTCACGTTTGAACCTT

GCGTAATGTGCGCGGGAGCTATGATTCACTCCCGCATTGG

ACGAGTTGTATTCGGTGTTCGCAACGCCAAGACGGGTGCC

GCAGGTTCACTGATGGACGTGCTGCATTACCCAGGCGGCG

AAACCGGGGAGATCGTGTGGGATAAGGGCCGGGATTTTGC

CACCGTGCGGAAAGTGCTGAGCATGCCCCAAGTGAATATC

GTGAAAAGACCGAGGTGCAGACAGGCGGCTTCAGCAAAG

AGTCTATCCTGCCCAAGAGGAACAGCGATAAGCTGATCGC

CAGAAAGAAGGACTGGGACCCTAAGAAGTACGGCGGCTTC

GACAGCCCCACCGTGGCCTATTCTGTGCTGGTGGTGGCCA

AAGTGGAAAAGGGCAAGTCCAAGAAACTGAAGAGTGTGAA

AGAGCTGCTGGGGATCACCATCATGGAAAGAAGCAGCTTC

GAGAAGAATCCCATCGACTTTCTGGAAGCCAAGGGCTACA

AAGAAGTGAAAAAGGACCTGATCATCAAGCTGCCTAAGTA

CTCCCTGTTCGAGCTGGAAAACGGCCGGAAGAGAATGCTG

GCCTCTGCCGGCGAACTGCAGAAGGGAAACGAACTGGCCC

TGCCCTCCAAATATGTGAACTTCCTGTACCTGGCCAGCCA

CTATGAGAAGCTGAAGGGCTCCCCCGAGGATAATGAGCAG

AAACAGCTGTTTGTGGAACAGCACAAGCACTACCTGGACG

AGATCATCGAGCAGATCAGCGAGTTCTCCAAGAGAGTGAT

CCTGGCCGACGCTAATCTGGACAAAGTGCTGTCCGCCTAC

AACAAGCACCGGGATAAGCCCATCAGAGAGCAGGCCGAGA

ATATCATCCACCTGTTTACCCTGACCAATCTGGGAGCCCC

TGCCGCCTTCAAGTACTTTGACACCACCATCGACCGGAAG

AGGTACACCAGCACCAAAGAGGTGCTGGACGCCACCCTGA

TCCACCAGAGCATCACCGGCCTGTACGAGACACGGATCGA

CCTGTCTCAGCTGGGAGGTGAC

IB3E029_ISLA: TadA-CP116ins 1067
MDKKYSIGLAIGTNSVGWAVITDEYKVPSKKFKVLGNTDR

HSIKKNLIGALLFDSGETAEATRLKRTARRRYTRRKNRIC

-continued

```
YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEEERLKTYA

HLFDDKVMKQLKRRRYTGWGRLSRKLINGIRDKQSGKTIL

DFLKSDGFANRNFMQLIHDDSLTFKEDIQKAQVSGQGDSL

EIEHIANLAGSPAIKKGILQTVKVVDELVKVMGRHKPENI

VIEMARENQTTQKGQKNSRERMKRIEEGIKELGSQILKEH

PVENTQLQNEKLYLYYLQNGRDMYVDQELDINRLSDYDVD

HIVPQSFLKDDSIDNKVLTRSDKNRGKSDNVPSEEVVKKM

KNYWRQLLNAKLITQRKFDNLTKAERGGLSELDKAGFIKR

QLVETRQITKHVAQILDSRMNTKYDENDKLIREVKVITLK

SKLVSDFRKDFQFYKVREINNYHHAHDAYLNAVVGTALIK

KYPKLESEFVYGDYKVYDVRKMIAKSEQEIGKATAKYFFY

SNIMNFFKTEITLANGEIRKRPLIETNMNEIRVEITEGIL

ADECAALLCYFFRMPRQVFNAQKKAQSSTDGSSGSETPGT

SESATPESSGSEVEFSHEYWMRHALTLAKRARDEREVPVG

AVLVLNNRVIGEGWNRAIGLHDPTAHAEIMALRQGGLVMQ

NYRL1DATLYVTFEPCVMCAGAMIHSRIGRVVFGVR

NAKTGAAGSLMDVLHYPGGETGEIVWDK

GRDFATVRKVLSMPQVNIVKKTEVQTGGFSKESILPKRNS

DKLIARKKDWDPKKYGGFDSPTVAYSVLVVAKVEKGKSKK

LKSVKELLGITIMERSSFEKNPIDFLEAKGYKEVKKDLII

KLPKYSLFELENGRKRMLASAGELQKGNELALPSKYVNFL

YLASHYEKLKGSPEDNEQKQLFVEQHKHYLDEIIEQISEF

SKRVILADANLDKVLSAYNKHRDKPIREQAENIIHLFTLT

NLGAPAAFKYFDTTIDRKRYTSTKEVLDATLIHQSITGLY

ETRIDLSQLGGD
```

```
IB3E031_ISLA: TadACP136ins 1248
ATGGACAAGAAGTACAGCATCGGCCTGGCCATCGGCACCA

ACTCTGTGGGCTGGGCCGTGATCACCGACGAGTACAAGGT
```

-continued

```
GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC
```

Line numbers in gutter (between columns): 5, 10, 15, 20, 25, 30, 35, 40, 45, 50, 55, 60, 65

-continued

```
GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGCGAAGATGATCGCCAAGAGCGAGCA

GGAAATCGGCAAGGCTACCGCCAAGTACTTCTTCTACAGC

AACATCATGAACTTTTTCAAGACCGAGATTACCCTGGCCA

ACGGCGAGATCCGGAAGCGGCCTCTGATCGAGACAAACGG

CGAAACCGGGGAGATCGTGTGGGATAAGGGCCGGGATTTT

GCCACCGTGCGGAAAGTGCTGAGCATGCCCCAAGTGAATA

TCGTGAAAAAGACCGAGGTGCAGACAGGCGGCTTCAGCAA
```

-continued

```
AGAGTCTATCCTGCCCAAGAGGAACAGCGATAAGCTGATC

GCCAGAAAGAAGGACTGGGACCCTAAGAAGTACGGCGGCT

TCGACAGCCCCACCGTGGCCTATTCTGTGCTGGTGGTGGC

CAAAGTGGAAAAGGGCAAGTCCAAGAAACTGAAGAGTGTG

AAAGAGCTGCTGGGGATCACCATCATGGAAAGAAGCAGCT

TCGAGAAGAATCCCATCGACTTTCTGGAAGCCAAGGGCTA

CAAAGAAGTGAAAAAGGACCTGATCATCAAGCTGCCTAAG

TACTCCCTGTTCGAGCTGGAAAACGGCCGGAAGAGAATGC

TGGCCTCTGCCGGCGAACTGCAGAAGGGAAACGAACTGGC

CCTGCCCTCCAAATATGTGAACTTCCTGTACCTGGCCAGC

CACTATGAGAAGCTGAAGGGCTCCATGAACCACCGGGTAG

AAATCACAGAAGGCATATTGGCGGACGAATGTGCGGCGCT

GTTGTGTTACTTTTTTCGCATGCCCAGGCAGGTCTTTAAC

GCCCAGAAAAAAGCACAATCCTCTACTGACGGTTCTAGCG

GCAGCGAGACTCCCGGGACCTCAGAGTCCGCCACACCCGA

AAGTTCTGGTTCCGAAGTCGAGTTTTCCCATGAGTACTGG

ATGAGACACGCATTGACTCTCGCAAAGAGGGCTCGAGATG

AACGCGAGGTGCCCGTGGGGGGCAGTACTCGTGCTCAACAA

TCGCGTAATCGGCGAAGGTTGGAATAGGGCAATCGGACTC

CACGACCCCACTGCACATGCGGAAATCATGGCCCTTCGAC

AGGGAGGGCTTGTGATGCAGAATTATCGACTTATCGATGC

GACGCTGTACGTCACGTTTGAACCTTGCGTAATGTGCGCG

GGAGCTATGATTCACTCCCGCATTGGACGAGTTGTATTCG

GTGTTCGCAACGCCAAGACGGGTGCCGCAGGTTCACTGAT

GGACGTGCTGCATTACCCAGGCCCCGAGGATAATGAGCAG

AAACAGCTGTTTGTGGAACAGCACAAGCACTACCTGGACG

AGATCATCGAGCAGATCAGCGAGTTCTCCAAGAGAGTGAT

CCTGGCCGACGCTAATCTGGACAAAGTGCTGTCCGCCTAC

AACAAGCACCGGGATAAGCCCATCAGAGAGCAGGCCGAGA

ATATCATCCACCTGTTTACCCTGACCAATCTGGGAGCCCC

TGCCGCCTTCAAGTACTTTGACACCACCATCGACCGGAAG

AGGTACACCAGCACCAAAGAGGTGCTGGACGCCACCCTGA

TCCACCAGAGCATCACCGGCCGTGTACGAGACACGGATCGA

CCTGTCTCAGCTGGGAGGTGAC
```

IBE031_ISLA: TadACP136ins 1248

```
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN
```

-continued

```
LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERNITNFDKNLPNEKVLPKHSLLYEYFT

VYNELTKVKYVTEGMRKPAFLSGEQKKAIVDLLFKTNRKV

TVKQLKEDYFKKIECFDSVETSGVEDRFNASLGTYHDLLK

IIKDKDFLDNEENEDILEDIVLTLTLFEDREMIEERLKTY

AHLFDDKVMKQLKRRRYTGWGRLSRKLINGIRDKQSGKTI

LDFLKSDGFANRNFMQLIHDDSLTFKEDIQKAQVSGQGDS

LHEHIANLAGSPAIKKGILQTVKVVDELVKVMGRHKPENI

VIEMARENQTTQKGQKNSRERMKRIEEGIKELGSQILKEH

PVENTQLQNEKLYLYYLQNGRDMYVDQELDINRLSDYDVD

HIVPQSFLKDDSIDNKVLTRSDKNRGKSDNVPSEEVVKKM

KNYWRQLLNAKLITQRKFDNLTKAERGGLSELDKAGFIKR

QLVETRQITKHVAQILDSRMNTKYDENDKLIREVKVITLK

SKLVSDFRKDFQFYKVREINNYHHAHDAYLNAVVGTALIK

KYPKLESEFVYGDYKVYDVRKMIAKSEQEIGKATAKYFFY

SNIMNFFKTEITLANGEIRKRPLIETNGETGEIVWDKGRD

FATVRKVLSMPQVNIVKKTEVQTGGFSKESILPKRNSDKL

IARKKDWDPKKYGGFDSPTVAYSVLVVAKVEKGKSKKLKS

VKELLGITIMERSSFEKNPIDFLEAKGYKEVKKDLIIKLP

KYSLFELENGRKRMLASAGELQKGNELALPSKYVNFLYLA

SHYEKLKGSMNIARVEITEGILADECAALLCYFFRMPRQV

FNAQKKAQSSTDGSSGSETPGTSESATPESSGSEVEFSHE

YWMRHALTLAKRARDEREVPVGAVLVLNNRVIGEGWNRAI

GLHDPTAHAEIMALRQGGLVMQNYRLIDATLYVTFEPCVM

CAGAMIHSRIGRVVFGVRNAKTGAAGSLMDVLHYPGPEDN

EQKQLFVEQHKHYLDEIIEQISEFSKRVILADANLDKVLS

AYNKHRDKPIREQAENIIHLFTLTNLGAPAAFKYFDTTID

RKRYTSTKEVLDATLIHQSITGLYETRIDLSQLGGD

IBE032_ISLA: TadACP136ins 1052
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG
```

-continued

```
ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA
```

5

10

15

20

25

30

35

40

45

50

55

60

65

-continued

```
GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACGACGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGGAAGATGATCGCCAAGAGCGAGCA

GGAAATCGGCAAGGCTACCGCCAAGTACTTCTTCTACAGC

AACATCATGAACTTTTTCAAGACCGAGATTACCCTGGCCA

TGAACCACCGGGTAGAAATCACAGAAGGCATATTGGCGGA

CGAATGTGCGGCGCTGTTGTGTTACTTTTTTCGCATGCCC

AGGCAGGTCTTTAACGCCCAGAAAAAAGCACAATCCTCTA

CTGACGGTTCTAGCGGCAGCGAGACTCCCGGGACCTCAGA

GTCCGCCACACCCGAAAGTTCTGGTTCCGAAGTCGAGTTT

TCCCATGAGTACTGGATGAGACACGCATTGACTCTCGCAA

AGAGGGCTCGAGATGAACGCGAGGTGCCCGTGGGGGCAGT

ACTCGTGCTCAACAATCGCGTAATCGGCGAAGGTTGGAAT

AGGGCAATCGGACTCCACGACCCCACTGCACATGCGGAAA
```

-continued

```
TCATGGCCCTTCGACAGGGAGGGCTTGTGATGCAGAATTA

TCGACTTATCGATGCGACGCTGTACGTCACGTTTGAACCT

TGCGTAATGTGCGCGGGAGCTATGATTCACTCCCGCATTG

GACGAGTTGTATTCGGTGTTCGCAACGCCAAGACGGGTGC

CGCAGGTTCACTGATGGACGTGCTGCATTACCCAGGCAAC

GGCGAGATCCGGAAGCGGCCTCTGATCGAGACAAACGGCG

AAACCGGGGAGATCGTGTGGGATAAGGGCCGGGATTTTGC

CACCGTGCGGAAAGTGCTGAGCATGCCCCAAGTGAATATC

GTGAAAAAGACCGAGGTGCAGACAGGCGGCTTCAGCAAAG

AGTCTATCCTGCCCAAGAGGAACAGCGATAAGCTGATCGC

CAGAAAGAAGGACTGGGACCCTAAGAAGTACGGCGGCTTC

GACAGCCCCACCGTGGCCTATTCTGTGCTGGTGGTGGCCA

AAGTGGAAAAGGGCAAGTCCAAGAAACTGAAGAGTGTGAA

AGAGCTGCTGGGGGATCACCATCATGGAAAGAAGCAGCTTC

GAGAAGAATCCCATCGACTTTCTGGAAGCCAAGGGCTACA

AAGAAGTGAAAAAGGACCTGATCATCAAGCTGCCTAAGTA

CTCCCTGTTCGAGCTGGAAAACGGCCGGAAGAGAATGCTG

GCCTCTGCCGGCGAACTGCAGAAGGGAAACGAACTGGCCC

TGCCCTCCAAATATGTGAACTTCCTGTACCTGGCCAGCCA

CTATGAGAAGCTGAAGGGCTCCCCCGAGGATAATGAGCAG

AAACAGCTGTTTGTGGAACAGCACAAGCACTACCTGGACG

AGATCATCGAGCAGATCAGCGAGTTCTCCAAGAGAGTGAT

CCTGGCCGACGCTAATCTGGACAAAGTGCTGTCCGCCTAC

AACAAGCACCGGGATAAGCCCATCAGAGAGCAGGCCGAGA

ATATCATCCACCTGTTTACCCTGACCAATCTGGGAGCCCC

TGCCGCCTTCAAGTACTTTGACACCACCATCGACCGGAAG

AGGTACACCAGCACCAAAGAGGTGCTGGACGCCACCCTGA

TCCACCAGAGCATCACCGGCCTGTACGAGACACGGATCGA

CCTGTCTCAGCTGGGAGGTGAC
```

IB3E032_ISLA: TadACP136ins 1052

```
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIFILGELHAILRRQEDFYPFLKDNREK
```

263

-continued

IEKILTFRIPYYVGPLARGNSRFAWMTRKSEETITPWNFE

EVVDKGASAQSFIERMTNFDKNLPNEKVLPKHSLLYEYFT

VYNELTKVKYVTEGMRKPAFLSGEQKKAIVDLLFKTNRKV

TVKQLKEDYFKKIECFDSVETSGVEDRFNASLGTYHDLLK

IIKDKDFLDNEENEDILEDIVLTLTLFEDREMIEERLKTY

AHLFDDKVMKQLKRRRYTGWGRLSRKLINGIRDKQSGKTI

LDFLKSDGFANRNFMQLIHDDSLTFKEDIQKAQVSGQGDS

LHEHIANLAGSPAIKKGILQTVKVVDELVKVMGRHKPENI

VIEMARENQTTQKGQKNSRERMKRIEEGIKELGSQILKEH

PVENTQLQNEKLYLYYLQNGRDMYVDQELDINRLSDYDVD

HIVPQSFLKDDSIDNKVLTRSDKNRGKSDNVPSEEVVKKM

KNYWRQLLNAKLITQRKFDNLTKAERGGLSELDKAGFIKR

QLVETRQITKHVAQILDSRMNTKYDENDKLIREVKVITLK

SKLVSDFRKDFQFYKVREINNYHHAHDAYLNAVVGTALIK

KYPKLESEFVYGDYKVYDVRKMIAKSEQEIGKATAKYFFY

SNIMNFFKTEITLAMNHRVEITEGILADECAALLCYFFRM

PRQVFNAQKKAQSSTDGSSGSETPGTSESATPESSGSEVE

FSHEWMRHALTLAKRARDEREVPVGAVLVLNNRVIGEGWN

RAIGLHDPTAHAEIMALRQGGLVMQNYRLIDATLYVTFEP

CVMCAGAMIHSRIGRVVFGVRNAKTGAAGSLMDVLHYPGN

GEIRKRPLIETNGETGEIVWDKGRDFATVRKVLSMPQVNI

VKKTEVQTGGFSKESILPKRNSDKLIARKKDWDPKKYGGF

DSPTVAYSVLVVAKVEKGKSKKLKSVKELLGITIMERSSF

EKNPIDFLEAKGYKEVKKDLIIKLPKYSLFELENGRKRML

ASAGELQKGNELALPSKYVNFLYLASHYEKLKGSPEDNEQ

KQLFVEQHKHYLDEIIEQISEFSKRVILADANLDKVLSAY

NKHRDKPIREQAENIIHLFTLTNLGAPAAFKYFDTTIDRK

RYTSTKEVLDATLIHQSITGLYETRIDLSQLGGD

IBE035_ISLA: delta 792-872 TadAins
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGCAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

264

-continued

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

-continued

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCTCCGAAGTCGAGTTTTCCCATGAG

TACTGGATGAGACACGCATTGACTCTCGCAAAGAGGGCTC

GAGATGAACGCGAGGTGCCCGTGGGGGCAGTACTCGTGCT

CAACAATCGCGTAATCGGCGAAGGTTGGAATAGGGCAATC

GGACTCCACGACCCCACTGCACATGCGGAAATCATGGCCC

TTCGACAGGGAGGGCTTGTGATGCAGAATTATCGACTTAT

CGATGCGACGCTGTACGTCACGTTTGAACCTTGCGTAATG

TGCGCGGGAGCTATGATTCACTCCCGCATTGGACGAGTTG

TATTCGGTGTTCGCAACGCCAAGACGGGTGCCGCAGGTTC

ACTGATGGACGTGCTGCATTACCCAGGCATGAACCACCGG

GTAGAAATCACAGAAGGCATATTGGCGGACGAATGTGCGG

CGCTGTTGTGTTACTTTTTTCGCATGCCCAGGCAGGTCTT

TAACGCCCAGAAAAAAGCACAATCCTCTACTGACGAAGAG

GTCGTGAAGAAGATGAAGAACTACTGGCGGCAGCTGCTGA

ACGCCAAGCTGATTACCCAGAGAAAGTTCGACAATCTGAC

CAAGGCCGAGAGAGGCGGCCTGAGCGAACTGGATAAGGCC

GGCTTCATCAAGAGACAGCTGGTGGAAACCCGGCAGATCA

CAAAGCACGTGGCACAGATCCTGGACTCCCGGATGAACAC

TAAGTACGACGAGAATGACAAGCTGATCCGGGAAGTGAAA

GTGATCACCCTGAAGTCCAAGCTGGTGTCCGATTTCCGGA

AGGATTTCCAGTTTTACAAAGTGCGCGAGATCAACAACTA

CCACCACGCCCACGACGCCTACCTGAACGCCGTCGTGGGA

ACCGCCCTGATCAAAAAGTACCCTAAGCTGGAAAGCGAGT

TCGTGTACGGCGACTACAAGGTGTACGACGTGCGCGAAGAT

GATCGCCAAGAGCGAGCAGGAAATCGGCAAGGCTACCGCC

AAGTACTTCTTCTACAGCAACATCATGAACTTTTTCAAGA

CCGAGATTACCCTGGCCAACGGCGAGATCCGGAAGCGGCC

TCTGATCGAGACAAACGGCGAAACCGGGGAGATCGTGTGG

GATAAGGGCCGGGATTTTG

CCACCGTGCGGAAAGTGCTGAGCATGCCCCAAGTGAATAT

CGTGAAAAAGACCGAGGTGCAGACAGGCGGCTTCAGCAAA

GAGTCTATCCTGCCCAAGAGGAACAGCGATAAGCTGATCG

CCAGAAAGAAGGACTGGGACCCTAAGAAGTACGGCGGCTT

CGACAGCCCCACCGTGGCCTATTCTGTGCTGGTGGTGGCC

-continued

AAAGTGGAAAAGGGCAAGTCCAAGAAACTGAAGAGTGTGA

AAGAGCTGCTGGGGATCACCATCATGGAAAGAAGCAGCTT

CGAGAAGAATCCCATCGACTTTCTGGAAGCCAAGGGCTAC

AAAGAAGTGAAAAAGGACCTGATCATCAAGCTGCCTAAGT

ACTCCCTGTTCGAGCTGGAAAACGGCCGGAAGAGAATGCT

GGCCTCTGCCGGCGAACTGCAGAAGGGAAACGAACTGGCC

CTGCCCTCCAAATATGTGAACTTCCTGTACCTGGCCAGCC

ACTATGAGAAGCTGAAGGGCTCCCCCGAGGATAATGAGCA

GAAACAGCTGTTTGTGGAACAGCACAAGCACTACCTGGAC

GAGATCATCGAGCAGATCAGCGAGTTCTCCAAGAGAGTGA

TCCTGGCCGACGCTAATCTGGACAAAGTGCTGTCCGCCTA

CAACAAGCACCGGGATAAGCCCATCAGAGAGCAGGCCGAG

AATATCATCCACCTGTTTACCCTGACCAATCTGGGAGCCC

CTGCCGCCTTCAAGTACTTTGACACCACCATCGACCGGAA

GAGGTACACCAGCACCAAAGAGGTGCTGGACGCCACCCTG

ATCCACCAGCATCACCGGCCTGTACGAGACACGGATCG

ACCTGTCTCAGCTGGGAGGTGAC

IB3E035_ISLA: delta 792-872 TadAins
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSEVEFSHE

YWMRHALTLAKRARDEREVPVGAVLVLNNRVIGEGWNRAI

GLHDPTAHAEIMALRQGGLVMQNYRLIDATLYVTFEPCVN

ICAGAMITISRIGRVVFGVRNAKTGAAGSLMDVLHYPGMN

-continued

HRVEITEGILADECAALLCYFFRMPRQVFNAQKKAQSSTD

EEVVKKMKNYWRQLLNAKLITQRKFDNLTKAERGGLSELD

KAGHKRQLVETRQITKHVAQILDSRMNTKYDENDKLIREV

KVITLKSKLVSDFRKDFQFYKVREINNYHTIAHDAYLNAV

VGTALIKKYPKLESEFVYGDYKVYDVRKMIAKSEQEIGKA

TAKYFFYSNIMNFFKTEITLANGEIRKRPLIETNGETGEI

VWDKGRDFATVRKVLSMPQVNIVKKTEVQTGGFSKESILP

KRNSDKLIARKKDWDPKKYGGFDSPTVAYSVLVVAKVEKG

KSKKLKSVKELLGITIMERSSFEKNPIDFLEAKGYKEVKK

DLIIKLPKYSLFELENGRKRMLASAGELQKGNELALPSKY

VNFLYLASHYEKLKGSPEDNEQKQLFVEQHKHYLDEIIEQ

ISEFSKRVILADANLDKVLSAYNKHRDKPIREQAENIIHL

FTLTNLGAPAAFKYFDTTIDRKRYTSTKEVLDATLIHQSI

TGLYETRIDLSQLGGD

IBE036 _ISLA: delta 792-906 TadAins
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAATGAAGCGGATCGAAGAGGG

CATCAAAGAGCTGGGCTCCGAAGTCGAGTTTTCCCATGAG

TACTGGATGAGACACGCATTGACTCTCGCAAAGAGGGCTC

GAGATGAACGCGAGGTGCCCGTGGGGGCAGTACTCGTGCT

CAACAATCGCGTAATCGGCGAAGGTTGGAATAGGGCAATC

GGACTCCACGACCCCACTGCACATGCGGAAATCATGGCCC

TTCGACAGGGAGGGCTTGTGATGCAGAATTATCGACTTAT

CGATGCGACGCTGTACGTCACGTTTGAACCTTGCGTAATG

-continued

```
TGCGCGGGAGCTATGATTCACTCCCGCATTGGACGAGTTG

TATTCGGTGTTCGCAACGCCAAGACGGGTGCCGCAGGTTC

ACTGATGGACGTGCTGCATTACCCAGGCATGAACCACCGG

GTAGAAATCACAGAAGGCATATTGGCGGACGAATGTGCGG

CGCTGTTGTGTTACTTTTTTCGCATGCCCAGGCAGGTCTT

TAACGCCCAGAAAAAAGCACAATCCTCTACTGACGGCCTG

AGCGAACTGGATAAGGCCGGCTTCATCAAGAGACAGCTGG

TGGAAACCCGGCAGATCACAAAGCACGTGGCACAGATCCT

GGACTCCCGGATGAACACTAAGTACGACGAGAATGACAAG

CTGATCCGGGAAGTGAAAGTGATCACCCTGAAGTCCAAGC

TGGTGTCCGATTTCCGGAAGGATTTCCAGTTTTACAAAGT

GCGCGAGATCAACAACTACCACCACGCCCACGACGCCTAC

CTGAACGCCGTCGTGGGAACCGCCCTGATCAAAAAGTACC

CTAAGCTGGAAAGCGAGTTCGTGTACGGCGACTACAAGGT

GTACGACGTGCGGAAGATGATCGCCAAGAGCGAGCAGGAA

ATCGGCAAGGCTACCGCCAAGTACTTCTTCTACAGCAACA

TCATGAACTTTTTCAAGACCGAGATTACCCTGGCCAACGG

CGAGATCCGGAAGCGGCCTCTGATCGAGACAAACGGCGAA

ACCGGGGAGATCGTGTGGGATAAGGGCCGGGATTTTGCCA

CCGTGCGGAAAGTGCTGAGCATGCCCCAAGTGAATATCGT

GAAAAAGACCGAGGTGCAGACAGGCGGCTTCAGCAAAGAG

TCTATCCTGCCCAAGAGGAACAGCGATAAGCTGATCGCCA

GAAAGAAGGACTGGGACCCTAAGAAGTACGGCGGCTTCGA

CAGCCCCACCGTGGCCTATTCTGTGCTGGTGGTGGCCAAA

GTGGAAAAGGGCAAGTCCAAGAAACTGAAGAGTGTGAAAG

AGCTGCTGGGGATCACCATCATGGAAAGAAGCAGCTTCGA

GAAGAATCCCATCGACTTTCTGGAAGCCAAGGGCTACAAA

GAAGTGAAAAAGGACCTGATCATCAAGCTGCCTAAGTACT

CCCTGTTCGAGCTGGAAAACGGCCGGAAGAGAATGCTGGC

CTCTGCCGGCGAACTGCAGAAGGGAAACGAACTGGCCCTG

CCCTCCAAATATGTGAACTTCCTGTACCTGGCCAGCCACT

ATGAGAAGCTGAAGGGCTCCCCCGAGGATAATGAGCAGAA

ACAGCTGTTTGTGGAACAGCACAAGCACTACCTGGACGAG

ATCATCGAGCAGATCAGCGAGTTCTCCAAGAGAGTGATCC

TGGCCGACGCTAATCTGGACAAAGTGCTGTCCGCCTACAA

CAAGCACCGGGATAAGCCCATCAGAGAGCAGGCCGAGAAT

ATCATCCACCTGTTTACCCTGACCAATCTGGGAGCCCCTG

CCGCCTTCAAGTACTTTGACACCACCATCGACCGGAAGAG

GTACACCAGCACCAAAGAGGTGCTGGACGCCACCCTGATC

CACCAGAGCATCACCGGCCTGTACGAGACACGGATCGACC

TGTCTCAGCTGGGAGGTGAC
```

-continued

```
IB3E036_ISLA: delta 792-906 TadAins
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMINFDKNLPNEKVLPKHSLLYEYFTV

YNELTKVKYVTEGMRKPAFLSGEQKKAIVDLLFKTNRKVT

VKQLKEDYFKKIECFDSVEISGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

EIEHIANLAGSPAIKKGILQTVKVVDELVKVMGRHKPENI

VIEMARENQTTQKGQKNSRERMKRIEEGIKELGSEVEFSH

EWMRHALTLAKRARDEREVPVGAVLVLNNRVIGEGWNRAI

GLHDPTAHAEIMALRQGGLVMQNYRLIDATLYVTFEPCVM

CAGAMIHSRIGRVVFGVRNAKTGAAGSLMDVLHYPGMNHR

VEITEGILADECAALLCYFFRMPRQVFNAQKKAQSSTDGL

SELDKAGFIKRQLVETRQITKHVAQILDSRMNTKYDENDK

LIREVKVITLKSKLVSDFRKDFQFYKVREINNYHHAHDAY

LNAVVGTALIKKYPKLESEFVYGDYKVYDVRKMIAKSEQE

IGKATAKYFFYSNIMNFFKTEITLANGEIRKRPLIETNGE

TGEIVWDKGRDFATVRKVLSMPQVNIVKKTEVQTGGFSKE

SILPKRNSDKLIARKKDWDPKKYGGFDSPTVAYSVLVVAK

VEKGKSKKLKSVKELLGITIMERSSFEKNPIDFLEAKGYK

EVKKDLIIKLPKYSLFELENGRKRMLASAGELQKGNELAL

PSKYVNFLYLASHYEKLKGSPEDNEQKQLFVEQHKHYLDE

IIEQISEFSKRVILADANLDKVLSAYNKHRDKPIREQAEN

IIHLFTLTNLGAPAAFKYFDTTIDRKRYTSTKEVLDATLI

HQSITGLYETRIDLSQLGGD

IBE043_ISLA: TadA CP65ins 1246
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG
```

-continued

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

-continued

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGCGAAGATGATCGCCAAGAGCGAGCA

GGAAATCGGCAAGGCTACCGCCAAGTACTTCTTCTACAGC

AACATCATGAACTTTTTCAAGACCGAGATTACCCTGGCCA

ACGGCGAGATCCGGAAGCGGCCTCTGATCGAGACAAACGG

CGAAACCGGGGAGATCGTGTGGGATAAGGGCCGGGATTTT

GCCACCGTGCGGAAAGTGCTGAGCATGCCCCAAGTGAATA

TCGTGAAAAAGACCGAGGTGCAGACAGGCGGCTTCAGCAA

AGAGTCTATCCTGCCCAAGAGGAACAGCGATAAGCTGATC

-continued

```
GCCAGAAAGAAGGACTGGGACCCTAAGAAGTACGGCGGCT

TCGACAGCCCCACCGTGGCCTATTCTGTGCTGGTGGTGGC

CAAAGTGGAAAAGGGCAAGTCCAAGAAACTGAAGAGTGTG

AAAGAGCTGCTGGGGATCACCATCATGGAAAGAAGCAGCT

TCGAGAAGAATCCCATCGACTTTCTGGAAGCCAAGGGCTA

CAAAGAAGTGAAAAAGGACCTGATCATCAAGCTGCCTAAG

TACTCCCTGTTCGAGCTGGAAAACGGCCGGAAGAGAATGC

TGGCCTCTGCCGGCGAACTGCAGAAGGGAAACGAACTGGC

CCTGCCCTCCAAATATGTGAACTTCCTGTACCTGGCCAGC

CACTATGAGAAGCTGAAGGGCACTGCACATGCGGAAATCA

TGGCCCTTCGACAGGGAGGGCTTGTGATGCAGAATTATCG

ACTTATCGATGCGACGCT

GTACGTCACGTTTGAACCTTGCGTAATGTGCGCGGGAGCT

ATGATTCACTCCCGCATTGGACGAGTTGTATTCGGTGTTC

GCAACGCCAAGACGGGTGCCGCAGGTTCACTGATGGACGT

GCTGCATTACCCAGGCATGAACCACCGGGTAGAAATCACA

GAAGGCATATTGGCGGACGAATGTGCGGCGCTGTTGTGTT

ACTTTTTTCGCATGCCCAGGCAGGTCTTTAACGCCCAGAA

AAAAGCACAATCCTCTACTGACGGTTCTAGCGGCAGCGAG

ACTCCCGGGACCTCAGAGTCCGCCACACCCGAAAGTTCTG

GTTCCGAAGTCGAGTTTTCCCATGAGTACTGGATGAGACA

CGCATTGACTCTCGCAAAGAGGGCTCGAGATGAACGCGAG

GTGCCCGTGGGGGCAGTACTCGTGCTCAACAATCGCGTAA

TCGGCGAAGGTTGGAATAGGGCAATCGGACTCCACGACCC

CTCCCCCGAGGATAATGAGCAGAAACAGCTGTTTGTGGAA

CAGCACAAGCACTACCTGGACGAGATCATCGAGCAGATCA

GCGAGTTCTCCAAGAGAGTGATCCTGGCCGACGCTAATCT

GGACAAAGTGCTGTCCGCCTACAACAAGCACCGGGATAAG

CCCATCAGAGAGCAGGCCGAGAATATCATCCACCTGTTTA

CCCTGACCAATCTGGGAGCCCCTGCCGCCTTCAAGTACTT

TGACACCACCATCGACCGGAAGAGGTACACCAGCACCAAA

GAGGTGCTGGACGCCACCCTGATCCACCAGAGCATCACCG

GCCTGTACGAGACACGGATCGACCTGTCTCAGCTGGGAGG
```

TGACB3E043_ISLA: TadA CP65ins 1246
```
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA
```

-continued

```
QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSQILKEHP

VENTQLQNEKLYLYYLQNGRDMYVDQELDINRLSDYDVDH

IVPQSFLKDDSIDNKVLTRSDKNRGKSDNVPSEEVVKKMK

NYWRQLLNAKLITQRKFDNLTKAERGGLSELDKAGFIKRQ

LVETRQITKHVAQILDSRMNTKYDENDKLIREVKVITLKS

KLVSDFRKDFQFYKVREINNYHHAHDAYLNAVVGTALIKK

YPKLESEFVYGDYKVYDVRKMIAKSEQEIGKATAKYFFYS

NIMNFFKTEITLANGEIRKRPLIETNGETGEIVWDKGRDF

ATVRKVLSMPQVNIVKKTEVQTGGFSKESILPKRNSDKLI

ARKKDWDPKKYGGFDSPTVAYSVLVVAKVEKGKSKKLKSV

KELLGITIMERSSFEKNPIDFLEAKGYKEVKKDLIIKLPK

YSLFELENGRKRMLASAGELQKGNELALPSKYVNFLYLAS

HYEKLKGTAHAEIMALRQGGLVMQNYRLIDATLYVTFEPC

VNICAGAMIHSRIGRVVFGVRNAKTGAAGSLMDVLHYPGM

NIARVEITEGILADECAALLCYFFRMPRQVFNAQKKAQSS

TDGSSGSETPGTSESATPESSGSEVEFSHEYWMRHALTLA

KRARDEREVPVGAVLVLNNRVIGEGWNRAIGLHDPSPEDN

EQKQLFVEQHKHYLDEIIEQISEFSKRVILADANLDKVLS

AYNKHRDKPIREQAENIIHLFTLTNLGAPAAFKYFDTTID

RKRYTSTKEVLDATLIHQSITGLYETRIDLSQLGGD
```

IB3E044_ISLA: TadAins C-term truncate2 791
```
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT
```

275 276

-continued

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

-continued

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGTTCTAGCGGCAGCGAGACTCCCGGG

ACCTCAGAGTCCGCCACACCCGAAAGTTCTGGTTCCGAAG

TCGAGTTTTCCCATGAGTACTGGATGAGACACGCATTGAC

TCTCGCAAAGAGGGCTCGAGATGAACGCGAGGTGCCCGTG

GGGGCAGTACTCGTGCTCAACAATCGCGTAATCGGCGAAG

GTTGGAATAGGGCAATCGGACTCCACGACCCCACTGCACA

TGCGGAAATCATGGCCCTTCGACAGGGAGGGCTTGTGATG

CAGAATTATCGACTTATCGATGCGACGCTGTACGTCACGT

TTGAACCTTGCGTAATGTGCGCGGGAGCTATGATTCACTC

CCGCATTGGACGAGTTGTATTCGGTGTTCGCAACGCCAAG

ACGGGTGCCGCAGGTTCACTGATGGACGTGCTGCATTACC

CAGGCATGAACCACCGGGTAGAAATCACAGAAGGCATATT

GGCGGACGAATGTGCGGCGCTGTTGTGTTACTTTTTTCGC

ATGCCCAGGCAGGGCAGCCAGATCCTGAAAGAACACCCCG

TGGAAAACACCCAGCTGCAGAACGAGAAGCTGTACCTGTA

CTACCTGCAGAATGGGCGGGATATGTACGTGGACCAGGAA

CTGGACATCAACCGGCTGTCCGACTACGATGTGGACCATA

TCGTGCCTCAGAGCTTTCTGAAGGACGACTCCATCGACAA

CAAGGTGCTGACCAGAAGCGACAAGAACCGGGGCAAGAGC

GACAACGTGCCCTCCGAAGAGGTCGTGAAGAAGATGAAGA

ACTACTGGCGGCAGCTGCTGAACGCCAAGCTGATTACCCA

GAGAAAGTTCGACAATCTGACCAAGGCCGAGAGAGGCGGC

CTGAGCGAACTGGATAAGGCCGGCTTCATCAAGAGACAGC

TGGTGGAAACCCGGCAGATCACAAAGCACGTGGCACAGAT

CCTGGACTCCCGGATGAACACTAAGTACGACGAGAATGAC

AAGCTGATCCGGGAAGTGAAAGTGATCACCCTGAAGTCCA

AGCTGGTGTCCGATTTCCGGAAGGATTTCCAGTTTTACAA

AGTGCGCGAGATCAACAACTACCACCACGCCCACGACGCC

TACCTGAACGCCGTCGTGGGAACCGCCCTGATCAAAAAGT

ACCCTAAGCTGGAAAGCGAGTTCGTGTACGGCGACTACAA

-continued

```
GGTGTACGACGTGCGGAAGATGATCGCCAAGAGCGAGCAG

GAAATCGGCAAGGCTACCGCCAAGTACTTCTTCTACAGCA

ACATCATGAACTTTTTCAAGACCGAGATTACCCTGGCCAA

CGGCGAGATCCGGAAGCGGCCTCTGATCGAGACAAACGGC

GAAACCGGGGAGATCGTGTGGGATAAGGGCCGGGATTTTG

CCACCGTGCGGAAAGTGCTGAGCATGCCCCAAGTGAATAT

CGTGAAAAAGACCGAGGTGCAGACAGGCGGCTTCAGCAAA

GAGTCTATCCTGCCCAAGAGGAACAGCGATAAGCTGATCG

CCAGAAAGAAGGACTGGGACCCTAAGAAGTACGGCGGCTT

CGACAGCCCCACCGTGGCCTATTCTGTGCTGGTGGTGGCC

AAAGTGGAAAAGGGCAAGTCCAAGAAACTGAAGAGTGTGA

AAGAGCTCGTGGGGATCACCATCATGGAAAGAAGCAGCTT

CGAGAAGAATCCCATCGACTTTCTGGAAGCCAAGGGCTAC

AAAGAAGTGAAAAAGGACCTGATCATCAAGCTGCCTAAGT

ACTCCCTGTTCGAGCTGGAAAACGGCCGGAAGAGAATGCT

GGCCTCTGCCGGCGAACTGCAGAAGGGAAACGAACTGGCC

CTGCCCTCCAAATATGTGAACTTCCTGTACCTGGCCAGCC

ACTATGAGAAGCTGAAGGGCTCCCCCGAGGATAATGAGCA

GAAACAGCTGTTTGTGGAACAGCACAAGCACTACCTGGAC

GAGATCATCGAGCAGATCAGCGAGTTCTCCAAGAGAGTGA

TCCTGGCCGACGCTAATCTGGACAAAGTGCTGTCCGCCTA

CAACAAGCACCGGGATAAGCCCATCAGAGAGCAGGCCGAG

AATATCATCCACCTGTTTACCCTGACCAATCTGGGAGCCC

CTGCCGCCTTCAAGTACTTTGACACCACCATCGACCGGAA

GAGGTACACCAGCACCAAAGAGGTGCTGGACGCCACCCTG

ATCCACCAGAGCATCACCGGCCTGTACGAGACACGGATCG

ACCTGTCTCAGCTGGGAGGTGAC
```

IB3E044_ISLA: TadAins C-term truncate2 791
```
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV
```

-continued

```
YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSSGSETPG

TSESATPESSGSEVEFSHEYWMRHALTLAKRARDEREVPV

GAVLVLNNRVIGEGWNRAIGLHDPTAHAEIMALRQGGLVM

QNYRLIDATLYVTFEPCVMCAGAMIHSRIGRVVFGVRNAK

TGAAGSLMDVLHYPGMNHRVEITEGILADECAALLCYFFR

MPRQGSQILKEHPVENTQLQNEKLYLYYLQNGRDMYVDQE

LDINRLSDYDVDHIVPQSFLKDDIDNKVLTRSDKNRGKSD

NVPSEEVVKKMKNYWRQLLNAKLITQRKFDNLTKAERGGL

SELDKAGFIKRQLVETRQITKHVAQILDSRMNTKYDENDK

LIREVKVITLKSKLVSDFRKDFQFYKVREINNYHHAHDAY

LNAVVGTALIKKYPKLESEFVYGDYKVYDVRKMIAKSEQE

IGKATAKYFFYSNIMNFFKTEITLANGEIRKRPLIETNGE

TGEIVWDKGRDFATVRKVLSMPQVNIVKKTEVQTGGFSKE

SILPKRNSDKLIARKKDWDPKKYGGFDSPTVAYSVLVVAK

VEKGKSKKLKSVKELLGITIMERSSFEKNPIDFLEAKGYK

EVKKDLIIKLPKYSLFELENGRKRMLASAGELQKGNELAL

PSKYVNFLYLASHYEKLKGSPEDNEQKQLFVEQHKHYLDE

IIEQISEFSKRVILADANLDKVLSAYNKHRDKPIREQAEN

IIHLFTLTNLGAPAAFKYFDTTIDRKRYTSTKEVLDATLI

HQSITGLYETRIDLSQLGGD
``` pHRB-043_GGS-rAP: rAPOBEC1-XTEN-ins-
site1_Y1016-D10A-UGIx2
```
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA
```

5

10

15

20

25

30

35

40

45

50

55

60

65

-continued

```
GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG
```

-continued

```
CACGAGCACACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGGAGGCTCTGGAGGAAGCAGCTCTGAGACAGG

ACCTGTGGCCGTGGATCCCACACTGCGGAGAAGAATTGAG

CCCCACGAGTTCGAGGTGTTCTTCGACCCCAGAGAGCTGC

GGAAAGAGACATGCCTGCTGTACGAGATCAACTGGGGCGG

CAGACACTCTATCTGGCGGCACACAAGCCAGAACACCAAC

AAGCACGTGGAAGTGAACTTTATCGAGAAGTTTACGACCG

AGCGGTACTTCTGCCCCAACACCAGATGCAGCATCACCTG

GTTTCTGAGCTGGTCCCCTTGCGGCGAGTGCAGCAGAGCC

ATCACCGAGTTTCTGTCCAGATATCCCCACGTGACCCTGT

TCATCTATATCGCCCGGCTGTACCACCACGCCGATCCTAG

AAATAGACAGGGCCTGCGCGACCTGATCAGCAGCGGAGTG

ACAATCCAGATCATGACCGAGCAAGAGAGCGGCTACTGCT

GGCGGAACTTCGTGAACTACAGCCCCAGCAACGAAGCCCA

CTGGCCTAGATATCCTCACCTGTGGGTCCGACTGTACGTG

CTGGAACTGTACTGCATCATCCTGGGCCTGCCTCCATGCC

TGAACATCCTGAGAAGAAAGCAGCCTCAGCTGACCTTCTT

CACAATCGCCCTGCAGAGCTGCCACTACCAGAGACTGCCT

CCACACATCCTGTGGGCCACCGGACTTAAGGGCTCTTCTG

GATCTGAAACACCTGGCACAAGTGAGAGCGCCACCCCTGA
```

-continued

GAGCTCTGGCGACGTGCGGAAGATGATCGCCAAGAGCGAG

CAGGAAATCGGCAAGGCTACCGCCAAGTACTTCTTCTACA

GCAACATCATGAACTTTTTCAAGACCGAGATTACCCTGGC

CAACGGCGAGATCCGGAAGCGGCCTCTGATCGAGACAAAC

GGCGAAACCGGGGAGATCGTGTGGGATAAGGGCCGGGATT

TTGCCACCGTGCGGAAAGTGCTGAGCATGCCCCAAGTGAA

TATCGTGAAAAAGACCGAGGTGCAGACAGGCGGCTTCAGC

AAAGAGTCTATCCTGCCCAAGAGGAACAGCGATAAGCTGA

TCGCCAGAAAGAAGGACTGGGACCCTAAGAAGTACGGCGG

CTTCGACAGCCCCACCGTGGCCTATTCTGTGCTGGTGGTG

GCCAAAGTGGAAAAGGGCAAGTCCAAGAAACTGAAGAGTG

TGAAAGAGCTGCTGGGGATCACCATCATGGAAAGAAGCAG

CTTCGAGAAGAATCCCATCGACTTTCTGGAAGCCAAGGGC

TACAAAGAAGTGAAAAAGGACCTGATCATCAAGCTGCCTA

AGTACTCCCTGTTCGAGCTGGAAAACGGCCGGAAGAGAAT

GCTGGCCTCTGCCGGCGAACTGCAGAAGGGAAACGAACTG

GCCCTGCCCTCCAAATATGTGAACTTCCTGTACCTGGCCA

GCCACTATGAGAAGCTGAAGGGCTCCCCCGAGGATAATGA

GCAGAAACAGCTGTTTGTGGAACAGCACAAGCACTACCTG

GACGAGATCATCGAGCAGATCAGCGAGTTCTCCAAGAGAG

TGATCCTGGCCGACGCTAATCTGGACAAAGTGCTGTCCGC

CTACAACAAGCACCGGGATAAGCCCATCAGAGAGCAGGCC

GAGAATATCATCCACCTGTTTACCCTGACCAATCTGGGAG

CCCCTGCCGCCTTCAAGTACTTTGACACCACCATCGACCG

GAAGAGGTACACCAGCACCAAAGAGGTGCTGGACGCCACC

CTGATCCACCAGAGCATCACCGGCCTGTACGAGACACGGA

TCGACCTGTCTCAGCTGGGAGGTGACTCTGGTGGAAGCGG

AGGATCTGGCGGCAGCACCAATCTGAGCGACATCATCGAG

AAAGAGACAGGCAAGCAGCTGGTCATCCAAGAGTCCATCC

TGATGCTGCCTGAAGAGGTGGAAGAAGTGATCGGCAACAA

GCCCGAGTCCGACATCCTGGTGCACACCGCCTACGATGAG

AGCACCGACGAGAACGTGATGCTGCTGACCTCTGACGCCC

CTGAGTACAAGCCTTGGGCTCTCGTGATCCAGGACAGCAA

CGGCGAGAACAAGATCAAGATGCTGAGCGGCGGCTCTGGT

GGCTCTGGCGGATCTACAAACCTGTCCGATATTATTGAGA

AAGAAACCGGGAAACAGCTCGTGATTCAAGAGTCTATTCT

CATGCTCCCGGAAGAAGTCGAGGAAGTCATTGGAAACAAG

CCTGAGAGCGATATTCTGGTCCATACAGCCTACGACGAGT

CTACCGATGAGAATGTCATGCTCCTCACCAGCGACGCTCC

CGAGTATAAGCCATGGGCACTTGTCATTCAGGACTCCAAT

-continued

GGGGAAAACAAAATCAAAATGCTCCCAAAGAAAAAACGCA

AGGTGGAGGGAGCTGATAAGCGCACCGCCGATGGTTCCGA

GTTCGAAAGCCCCAAGAAGAAGAGGAAAGTCTAACCGGTC

ATCATCACCATCACCATTGAGTTTAAACCCGCTGATCAGC

CTCGACTGTGCCTTCTAGTTGCCAGCCATCTGTTGTTTGC

CCCTCCCCCGTGCCTTCCTTGACCCTGGAAGGTGCCACTC

CCACTGTCCTTTCCTAATAAAATGAGGAAATTGCATCGCA

TTGTCTGAGTAGGTGTCATTCTATTCTGGGGGGTGGGGTG

GGGCAGGACAGCAAGGGGGAGGATTGGGAAGACAATAGCA

GGCATGCTGGGGATGCGGTGGGCTCTATGGCTTCTGAGGC

GGAAAGAACCAGCTGGGGCTCGATACCGTCGACCTCTAGC

TAGAGCTTGGCGTAATCATGGTCATAGCTGTTTCCTGTGT

GAAATTGTTATCCGCTCACAATTCCACACAACATACGAGC

CGGAAGCATAAAGTGTAAAGCCTAGGGTGCCTAATGAGTG

AGCTAACTCACATTAATTGCGTTGCGCTCACTGCCCGCTT

TCCAGTCGGGAAACCTGTCGTGCCAGCTGCATTAATGAAT

CGGCCAACGCGCGGGGAGAGGCGGTTTGCGTATTGGGCGC

TCTTCCGCTTCCTCGCTCACTGACTCGCTGCGCTCGGTCG

TTCGGCTGCGGCGAGCGGTATCAGCTCACTCAAAGGCGGT

AATACGGTTATCCACAGAATCAGGGGATAACGCAGGAAAG

AACATGTGAGCAAAAGGCCAGCAAAAGGCCAGGAACCGTA

AAAAGGCCGCGTTGCTGGCGTTTTTCCATAGGCTCCGCCC

CCCTGACGAGCATCACAAAAATCGACGCTCAAGTCAGAGG

TGGCGAAACCCGACAGGACTATAAAGATACCAGGCGTTTC

CCCCTGGAAGCTCCCTCGTGCGCTCTCCTGTTCCGACCCT

GCCGCTTACCGGATACCTGTCCGCCTTTCTCCCTTCGGGA

AGCGTGGCGCTTTCTCATAGCTCACGCTGTAGGTATCTCA

GTTCGGTGTAGGTCGTTCGCTCCAAGCTGGGCTGTGTGCA

CGAACCCCCCGTTCAGCCCGACCGCTGCGCCTTATCCGGT

AACTATCGTCTTGAGTCCAACCCGGTAAGACACGACTTAT

CGCCACTGGCAGCAGCCACTGGTAACAGGATTAGCAGAGC

GAGGTATGTAGGCGGTGCTACAGAGTTCTTGAAGTGGTGG

CCTAACTACGGCTACACTAGAAGAACAGTATTTGGTATCT

GCGCTCTGCTGAAGCCAGTTACCTTCGGAAAAAGAGTTGG

TAGCTCTTGATCCGGCAAACAAACCACCGCTGGTAGCGGT

GGTTTTTTTGTTTGCAAGCAGCAGATTACGCGCAGAAAAA

AAGGATCTCAAGAAGATCCTTTGATCTTTTCTACGGGGTC

TGACGCTCAGTGGAACGAAAACTCACGTTAAGGGATTTTG

GTCATGAGATTATCAAAAAGGATCTTCACCTAGATCCTTT

TAAATTAAAAATGAAGTTTTAAATCAATCTAAAGTATATA

TGAGTAAACTTGGTCTGACAGTTACCAATGCTTAATCAGT

-continued

```
GAGGCACCTATCTCAGCGATCTGTCTATTTCGTTCATCCA

TAGTTGCCTGACTCCCCGTCGTGTAGATAACTACGATACG

GGAGGGCTTACCATCTGGCCCCAGTGCTGCAATGATACCG

CGAGACCCACGCTCACCGGCTCCAGATTTATCAGCAATAA

ACCAGCCAGCCGGAAGGGCCGAGCGCAGAAGTGGTCCTGC

AACTTTATCCGCCTCCATCCAGTCTATTAATTGTTGCCGG

GAAGCTAGAGTAAGTAGTTCGCCAGTTAATAGTTTGCGCA

ACGTTGTTGCCATTGCTACAGGCATCGTGGTGTCACGCTC

GTCGTTTGGTATGGCTTCATTCAGCTCCGGTTCCCAACGA

TCAAGGCGAGTTACATGATCCCCCATGTTGTGCAAAAAAG

CGGTTAGCTCCTTCGGTCCTCCGATCGTTGTCAGAAGTAA

GTTGGCCGCAGTGTTATCACTCATGGTTATGGCAGCACTG

CATAATTCTCTTACTGTCATGCCATCCGTAAGATGCTTTT

CTGTGACTGGTGAGTACTCAACCAAGTCATTCTGAGAATA

GTGTATGCGGCGACCGAGTTGCTCTTGCCCGGCGTCAATA

CGGGATAATACCGCGCCACATAGCAGAACTTTAAAAGTGC

TCATCATTGGAAAACGTTCTTCGGGGCGAAAACTCTCAAG

GATCTTACCGCTGTTGAGATCCAGTTCGATGTAACCCACT

CGTGCACCCAACTGATCTTCAGCATCTTTTACTTTCACCA

GCGTTTCTGGGTGAGCAAAAACAGGAAGGCAAAATGCCGC

AAAAAAGGGAATAAGGGCGACACGGAAATGTTGAATACTC

ATACTCTTCCTTTTTCAATATTATTGAAGCATTTATCAGG

GTTATTGTCTCATGAGCGGATACATATTTGAATGTATTTA

GAAAAATAAACAAATAGGGGTTCCGCGCACATTTCCCCGA

AAAGTGCCACCTGACGTCGACGGATCGGGAGATCGATCTC

CCGATCCCCTAGGGTCGACTCTCAGTACAATCTGCTCTGA

TGCCGCATAGTTAAGCCAGTATCTGCTCCCTGCTTGTGTG

TTGGAGGTCGCTGAGTAGTGCGCGAGCAAAATTTAAGCTA

CAACAAGGCAAGGCTTGACCGACAATTGCATGAAGAATCT

GCTTAGGGTTAGGCGTTTTGCGCTGCTTCGCGATGTACGG

GCCAGATATACGCGTTGACATTGATTATTGACTAGTTATT

AATAGTAATCAATTACGGGGTCATTAGTTCATAGCCCATA

TATGGAGTTCCGCGTTACATAACTTACGGTAAATGGCCCG

CCTGGCTGACCGCCCAACGACCCCCGCCCATTGACGTCAA

TAATGACGTATGTTCCCATAGTAACGCCAATAGGGACTTT

CCATTGACGTCAATGGGTGGAGTATTTACGGTAAACTGCC

CACTTGGCAGTACATCAAGTGTATCATATGCCAAGTACGC

CCCCTATTGACGTCAATGACGGTAAATGGCCCGCCTGGCA

TTATGCCCAGTACATGACCTTATGGGACTTTCCTACTTGG

CAGTACATCTACGTATTAGTCATCGCTATTACCATGGTGA
```

-continued

```
TGCGGTTTTGGCAGTACATCAATGGGCGTGGATAGCGGTT

TGACTCACGGGGATTTCCAAGTCTCCACCCCATTGACGTC

AATGGGAGTTTGTTTTGGCACCAAAATCAACGGGACTTTC

CAAAATGTCGTAACAACTCCGCCCCATTGACGCAAATGGG

CGGTAGGCGTGTACGGTGGGAGGTCTATATAAGCAGAGCT

GGTTTAGTGAACCGTCAGATCCGCTAGAGATCCGCGGCCG

CTAATACGACTCACTATAGGGAGAGCCGCCACC
``` pHRB-043_GGS-rAP: rAPOBEC1-XTEN-ins-
site1_Y1016-D10A-UGIx2

```
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSQILKEHP

VENTQLQNEKLYLYYLQNGRDMYVDQELDINRLSDYDVDH

IVPQSFLKDDSIDNKVLTRSDKNRGKSDNVPSEEVVKKMK

NYWRQLLNAKLITQRKFDNLTKAERGGLSELDKAGFIKRQ

LVETRQITKHVAQILDSRMNTKYDENDKLIREVKVITLKS

KLVSDFRKDFQFYKVREINNYHHAHDAYLNAVVGTALIKK

YPKLESEFVYGDYKVYGGSGGSSETGPVAVDPTLRRRIE

PHEFEVFFDPRELRKETCLLYEINWGGRHSIWRHTSQNTN

KHVEVNFIEKFTTERYFCPNTRCSITWFLSWSPCGECSRA

ITEFLSRYPHVTLFIYIARLYHHADPRNRQGLRDLISSGV

TIQIMTEQESGYCWRNFVNYSPSNEAHVVPRYPHLWVRLY

VLELYCIILGLPPCLNILRRKQPQLTFFTIALQSCHYQRL

PPHILWATGLKGSSGSETPGTSESATPESSGDVRKMIAKS

EQEIGKATAKYFFYSNIMNFFKTEITLANGEIRKRPLIET
```

-continued

NGETGEIVWDKGRDFATVRKVLSMPQVNIVKKTEVQTGGF

SKESILPKRNSDKLIARKKDWDPKKYGGFDSPTVAYSVLV

VAKVEKGKSKKLKSVKELLGITIMERSSFEKNPIDFLEAK

GYKEVKKDLIIKLPKYSLFELENGRKRMLASAGELQKGNE

LALPSKYVNFLYLASHYEKLKGSPEDNEQKQLFVEQHKHY

LDEIIEQISEFSKRVILADANLDKVLSAYNKHRDKPIREQ

AENIIHLFTLTNLGAPAAFKYFDTTIDRKRYTSTKEVLDA

TLIHQSITGLYETRIDLSQLGGDSGGSGGSGGSTNLSDII

EKETGKQLVIQESILMLPEEVEEVIGNKPESDILVHTAYD

ESTDENVMLLTSDAPEYKPWALVIQDSNGENKIKMLSGGS

GGSGGSTNLSDIIEKETGKQLVIQESILMLPEEVEEVIGN

KPESDILVHTAYDESTDENVMLLTSDAPEYKPWALVIQDS

NGENKIKMLPKKKRKVEGADKRTADGSEFESPKKKRKV* pHRB-044_GGS-rAP: rAPOBEC1-XTEN-ins-
site2_A1023-D10A-UGIx2
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

GAAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

-continued
CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

-continued

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGGAAGATGATCGCCGGAGGCTCTGG

AGGAAGCAGCTCTGAGACAGGACCTGTGGCCGTGGATCCC

ACACTGCGGAGAAGAATTGAGCCCCACGAGTTCGAGGTGT

TCTTCGACCCCAGAGAGCTGCGGAAAGAGACATGCCTGCT

GTACGAGATCAACTGGGGCGGCAGACACTCTATCTGGCGG

CACACAAGCCAGAACACCAACAAGCACGTGGAAGTGAACT

TTATCGAGAAGTTTACGACCGAGCGGTACTTCTGCCCCAA

CACCAGATGCAGCATCACCTGGTTTCTGAGCTGGTCCCCT

TGCGGCGAGTGCAGCAGAGCCATCACCGAGTTTCTGTCCA

GATATCCCCACGTGACCCTGTTCATCTATATCGCCCGGCT

GTACCACCACGCCGATCCTAGAAATAGACAGGGCCTGCGC

GACCTGATCAGCAGCGGAGTGACAATCCAGATCATGACCG

AGCAAGAGAGCGGCTACTGCTGGCGGAACTTCGTGAACTA

CAGCCCCAGCAACGAAGCCCACTGGCCTAGATATCCTCAC

CTGTGGGTCCGACTGTACGTGCTGGAACTGTACTGCATCA

TCCTGGGCCTGCCTCCATGCCTGAACATCCTGAGAAGAAA

GCAGCCTCAGCTGACCTTCTTCACAATCGCCCTGCAGAGC

TGCCACTACCAGAGACTGCCTCCACACATCCTGTGGGCCA

CCGGACTTAAGGGCTCTTCTGGATCTGAAACACCTGGCAC

AAGTGAGAGCGCCACCCCTGAGAGCTCTGGCAAGAGCGAG

CAGGAAATCGGCAAGGCTACCGCCAAGTACTTCTTCTACA

GCAACATCATGAACTTTTTCAAGACCGAGATTACCCTGGC

CAACGGCGAGATCCGGAAGCGGCCTCTGATCGAGACAAAC

GGCGAAACCGGGGAGATCGTGTGGGATAAGGGCCGGGATT

TTGCCACCGTGCGGAAAGTGCTGAGCATGCCCCAAGTGAA

TATCGTGAAAAAGACCGAGGTGCAGACAGGCGGCTTCAGC

AAAGAGTCTATCCTGCCCAAGAGGAACAGCGATAAGCTGA

TCGCCAGAAAGAAGGACTGGGACCCTAAGAAGTACGGCGG

CTTCGACAGCCCCACCGTGGCCTATTCTGTGCTGGTGGTG

GCCAAAGTGGAAAAGGGCAAGTCCAAGAAACTGAAGAGTG

TGAAAGAGCTGCTGGGGATCACCATCATGGAAAGAAGCAG

-continued

CTTCGAGAAGAATCCCATCGACTTTCTGGAAGCCAAGGGC

TACAAAGAAGTGAAAAAGGACCTGATCATCAAGCTGCCTA

AGTACTCCCTGTTCGAGCTGGAAAACGGCCGGAAGAGAAT

GCTGGCCTCTGCCGGCGAACTGCAGAAGGGAAACGAACTG

GCCCTGCCCTCCAAATATGTGAACTTCCTGTACCTGGCCA

GCCACTATGAGAAGCTGAAGGGCTCCCCCGAGGATAATGA

GCAGAAACAGCTGTTTGTGGAACAGCACAAGCACTACCTG

GACGAGATCATCGAGCAGATCAGCGAGTTCTCCAAGAGAG

TGATCCTGGCCGACGCTAATCTGGACAAAGTGCTGTCCGC

CTACAACAAGCACCGGGATAAGCCCATCAGAGAGCAGGCC

GAGAATATCATCCACCTGTTTACCCTGACCAATCTGGGAG

CCCCTGCCGCCTTCAAGTACTTTGACACCACCATCGACCG

GAAGAGGTACACCAGCACCAAAGAGGTGCTGGACGCCACC

CTGATCCACCAGAGCATCACCGGCCTGTACGAGACACGGA

TCGACCTGTCTCAGCTGGGGAGGTGACTCTGGTGGAAGCGG

AGGATCTGGCGGCAGCACCAATCTGAGCGACATCATCGAG

AAAGAGACAGGCAAGCAGCTGGTCATCCAAGAGTCCATCC

TGATGCTGCCTGAAGAGGTGGAAGAAGTGATCGGCAACAA

GCCCGAGTCCGACATCCTGGTGCACACCGCCTACGATGAG

AGCACCGACGAGAACGTGATGCTGCTGACCTCTGACGCCC

CTGAGTACAAGCCTTGGGCTCTCGTGATCCAGGACAGCAA

CGGCGAGAACAAGATCAAGATGCTGAGCGGCGGCTCTGGT

GGCTCTGGCGGATCTACAAACCTGTCCGATATTATTGAGA

AAGAAACCGGGAAACAGCTCGTGATTCAAGAGTCTATTCT

CATGCTCCCGGAAGAAGTCGAGGAAGTCATTGGAAACAAG

CCTGAGAGCGATATTCTGGTCCATACAGCCTACGACGAGT

CTACCGATGAGAATGTCATGCTCCTCACCAGCGACGCTCC

CGAGTATAAGCCATGGGCACTTGTCATTCAGGACTCCAAT

GGGGAAAACAAAATCAAAATGCTCCCAAAGAAAAAACGCA

AGGTGGAGGGAGCTGATAAGCGCACCGCCGATGGTTCCGA

GTTCGAAAGCCCCAAGAAGAAGAGGAAAGTCTAACCGGTC

ATCATCACCATCACCATTGAGTTTAAACCCGCTGATCAGC

CTCGACTGTGCCTTCTAGTTGCCAGCCATCTGTTGTTTGC

CCCTCCCCCGTGCCTTCCTTGACCCTGGAAGGTGCCACTC

CCACTGTCCTTTCCTAATAAAATGAGGAAATTGCATCGCA

TTGTCTGAGTAGGTGTCATTCTATTCTGGGGGGTGGGGTG

GGGCAGGACAGCAAGGGGGAGGATTGGGAAGACAATAGCA

GGCATGCTGGGGATGCGGTGGGCTCTATGGCTTCTGAGGC

GGAAAGAACCAGCTGGGGCTCGATACCGTCGACCTCTAGC

TAGAGCTTGGCGTAATCATGGTCATAGCTGTTTCCTGTGT

GAAATTGTTATCCGCTCACAATTCCACACAACATACGAGC 5
10
15
20
25
30
35
40
45
50
55
60
65

-continued

```
CGGAAGCATAAAGTGTAAAGCCTAGGGTGCCTAATGAGTG

AGCTAACTCACATTAATTGCGTTGCGCTCACTGCCCGCTT

TCCAGTCGGGAAACCTGTCGTGCCAGCTGCATTAATGAAT

CGGCCAACGCGCGGGGAGAGGCGGTTTGCGTATTGGGCGC

TCTTCCGCTTCCTCGCTCACTGACTCGCTGCGCTCGGTCG

TTCGGCTGCGGCGAGCGGTATCAGCTCACTCAAAGGCGGT

AATACGGTTATCCACAGAATCAGGGGATAACGCAGGAAAG

AACATGTGAGCAAAAGGCCAGCAAAAGGCCAGGAACCGTA

AAAAGGCCGCGTTGCTGGCGTTTTTCCATAGGCTCCGCCC

CCCTGACGAGCATCACAAAAATCGACGCTCAAGTCAGAGG

TGGCGAAACCCGACAGGACTATAAAGATACCAGGCGTTTC

CCCCTGGAAGCTCCCTCGTGCGCTCTCCTGTTCCGACCCT

GCCGCTTACCGGATACCTGTCCGCCTTTCTCCCTTCGGGA

AGCGTGGCGCTTTCTCATAGCTCACGCTGTAGGTATCTCA

GTTCGGTGTAGGTCGTTCGCTCCAAGCTGGGCTGTGTGCA

CGAACCCCCCGTTCAGCCCGACCGCTGCGCCTTATCCGGT

AACTATCGTCTTGAGTCCAACCCGGTAAGACACGACTTAT

CGCCACTGGCAGCAGCCACTGGTAACAGGATTAGCAGAGC

GAGGTATGTAGGCGGTGCTACAGAGTTCTTGAAGTGGTGG

CCTAACTACGGCTACACTAGAAGAACAGTATTTGGTATCT

GCGCTCTGCTGAAGCCAGTTACCTTCGGAAAAAGAGTTGG

TAGCTCTTGATCCGGCAAACAAACCACCGCTGGTAGCGGT

GGTTTTTTTGTTTGCAAGCAGCAGATTACGCGCAGAAAAA

AAGGATCTCAAGAAGATCCTTTGATCTTTTCTACGGGGTC

TGACGCTCAGTGGAACGAAAACTCACGTTAAGGGATTTTG

GTCATGAGATTATCAAAAAGGATCTTCACCTAGATCCTTT

TAAATTAAAAATGAAGTTTTAAATCAATCTAAAGTATATA

TGAGTAAACTTGGTCTGACAGTTACCAATGCTTAATCAGT

GAGGCACCTATCTCAGCGATCTGTCTATTTCGTTCATCCA

TAGTTGCCTGACTCCCCGTCGTGTAGATAACTACGATACG

GGAGGGCTTACCATCTGGCCCCAGTGCTGCAATGATACCG

CGAGACCCACGCTCACCGGCTCCAGATTTATCAGCAATAA

ACCAGCCAGCCGGAAGGGCCGAGCGCAGAAGTGGTCCTGC

AACTTTATCCGCCTCCATCCAGTCTATTAATTGTTGCCGG

GAAGCTAGAGTAAGTAGTTCGCCAGTTAATAGTTTGCGCA

ACGTTGTTGCCATTGCTACAGGCATCGTGGTGTCACGCTC

GTCGTTTGGTATGGCTTCATTCAGCTCCGGTTCCCAACGA

TCAAGGCGAGTTACATGATCCCCCATGTTGTGCAAAAAAG

CGGTTAGCTCCTTCGGTCCTCCGATCGTTGTCAGAAGTAA

GTTGGCCGCAGTGTTATCACTCATGGTTATGGCAGCACTG
```

-continued

```
CATAATTCTCTTACTGTCATGCCATCCGTAAGATGCTTTT

CTGTGACTGGTGAGTACTCAACCAAGTCATTCTGAGAATA

GTGTATGCGGCGACCGAGTTGCTCTTGCCCGGCGTCAATA

CGGGATAATACCGCGCCACATAGCAGAACTTTAAAAGTGC

TCATCATTGGAAAACGTTCTTCGGGGCGAAAACTCTCAAG

GATCTTACCGCTGTTGAGATCCAGTTCGATGTAACCCACT

CGTGCACCCAACTGATCTTCAGCATCTTTTACTTTCACCA

GCGTTTCTGGGTGAGCAAAAACAGGAAGGCAAAATGCCGC

AAAAAAGGGAATAAGGGCGACACGGAAATGTTGAATACTC

ATACTCTTCCTTTTTCAATATTATTGAAGCATTTATCAGG

GTTATTGTCTCATGAGCGGATACATATTTGAATGTATTTA

GAAAAATAAACAAATAGGGGTTCCGCGCACATTTCCCCGA

AAAGTGCCACCTGACGTCGACGGATCGGGAGATCGATCTC

CCGATCCCCTAGGGTCGACTCTCAGTACAATCTGCTCTGA

TGCCGCATAGTTAAGCCAGTATCTGCTCCCTGCTTGTGTG

TTGGAGGTCGCTGAGTAGTGCGCGAGCAAAATTTAAGCTA

CAACAAGGCAAGGCTTGACCGACAATTGCATGAAGAATCT

GCTTAGGGTTAGGCGTTTTGCGCTGCTTCGCGATGTACGG

GCCAGATATACGCGTTGACATTGATTATTGACTAGTTATT

AATAGTAATCAATTACGGGGTCATTAGTTCATAGCCCATA

TATGGAGTTCCGCGTTACATAACTTACGGTAAATGGCCCG

CCTGGCTGACCGCCCAACGACCCCCGCCCATTGACGTCAA

TAATGACGTATGTTCCCATAGTAACGCCAATAGGGACTTT

CCATTGACGTCAATGGGTGGAGTATTTACGGTAAACTGCC

CACTTGGCAGTACATCAAGTGTATCATATGCCAAGTACGC

CCCCTATTGACGTCAATGACGGTAAATGGCCCGCCTGGCA

TTATGCCCAGTACATGACCTTATGGGACTTTCCTACTTGG

CAGTACATCTACGTATTAGTCATCGCTATTACCATGGTGA

TGCGGTTTTGGCAGTACATCAATGGGCGTGGATAGCGGTT

TGACTCACGGGGATTTCCAAGTCTCCACCCCATTGACGTC

AATGGGAGTTTGTTTTGGCACCAAAATCAACGGGACTTTC

CAAAATGTCGTAACAACTCCGCCCCATTGACGCAAATGGG

CGGTAGGCGTGTACGGTGGGAGGTCTATATAAGCAGAGCT

GGTTTAGTGAACCGTCAGATCCGCTAGAGATCCGCGGCCG

CTAATACGACTCACTATAGGGAGAGCCGCCACC pHRB-044_GGS-rAP: rAPOBEC1-XTEN-ins-
site2_A1023-D10A-UGIx2
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP
```

-continued

```
INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMINFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

HEHIANLAGSPAIKKGILQTVKVVDELVKVMGRHKPENIV

IEMARENQTTQKGQKNSRERMKRIEEGIKELGSQILKEHP

VENTQLQNEKLYLYYLQNGRDMYVDQELDINRLSDYDVDH

IVPQSFLKDDSIDNKVLTRSDKNRGKSDNVPSEEVVKKMK

NYWRQLLNAKLITQRKFDNLTKAERGGLSELDKAGFIKRQ

LVETRQITKHVAQILDSRMNTKYDENDKLIREVKVITLKS

KLVSDFRKDFQFYKVREINNYHHAHDAYLNAVVGTALIKK

YPKLESEFVYGDYKVYDVRKMIAGGSGGSSSETGPVAVDP

TLRRRIEPHEFEVFFDPRELRKETCLLYEINWGGRHSIWR

HTSQNTNKHVEVNFIEKFTTERYFCPNTRCSITWFLSWSP

CGECSRAITEFLSRYPHVTLFIYIARLYHHADPRNRQGLR

DLISSGVTIQIMTEQESGYCWRNFVNYSPSNEAHWPRYPH

LWVRLYVLELYCIILGLPPCLNILRRKQPQLTFFTIALQS

CHYQRLPPHILWATGLKGSSGSETPGTSESATPESSGKSE

QEIGKATAKYFFYSNIMNFFKTEITLANGEIRKRPLIETN

GETGEIVWDKGRDFATVRKVLSMPQVNIVKKTEVQTGGFS

KESILPKRNSDKLIARKKDWDPKKYGGFDSPTVAYSVLVV

AKVEKGKSKKLKSVKELLGITIMERSSFEKNPIDFLEAKG

YKEVKKDLIIKLPKYSLFELENGRKRMLASAGELQKGNEL

ALPSKYVNFLYLASHYEKLKGSPEDNEQKQLFVEQHKHYL

DEIIEQISEFSKRVILADANLDKVLSAYNKEIRDKPIREQ

AENIIHLFTLTNLGAPAAFKYFDTTIDRKRYTSTKEVLDA

TLIHQSITGLYETRIDLSQLGGDSGGSGGSGGSTNLSDII

EKETGKQLVIQESILMLPEEVEEVIGNKPESDILVHTAYD

ESTDENVMLLTSDAPEYKPWALVIQDSNGENKIKMLSGGS
```

-continued

```
GGSGGGSTNLSDIIEKETGKQLVIQESILMLPEEVEEVIGN

KPESDILVHTAYDESTDENVMLLTSDAPEYKPWALVIQDS

NGENKIKMLPKKKRKVEGADKRTADGSEFESPKKKRKV*
``` pHRB-045_GGS-rAP: rAPOBEC1-XTEN-ins-
site3_E1029-D10A-UGIx2
```
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC
```

-continued

```
GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGGAAGATGATCGCCAAGAGCGAGCA
```

-continued

```
GGAAATCGGAGGCTCTGGAGGAAGCAGCTCTGAGACAGGA

CCTGTGGCCGTGGATCCCACACTGCCGGAGAAGAATTGAGC

CCCACGAGTTCGAGGTGTTCTTCGACCCCAGAGAGCTGCG

GAAAGAGACATGCCTGCTGTACGAGATCAACTGGGGCGGC

AGACACTCTATCTGGCGGCACACAAGCCAGAACACCAACA

AGCACGTGGAAGTGAACTTTATCGAGAAGTTTACGACCGA

GCGGTACTTCTGCCCCAACACCAGATGCAGCATCACCTGG

TTTCTGAGCTGGTCCCCTTGCGGCGAGTGCAGCAGAGCCA

TCACCGAGTTTCTGTCCAGATATCCCCACGTGACCCTGTT

CATCTATATCGCCCGGCTGTACCACCACGCCGATCCTAGA

AATAGACAGGGCCTGCGCGACCTGATCAGCAGCGGAGTGA

CAATCCAGATCATGACCGAGCAAGAGAGCGGCTACTGCTG

GCGGAACTTCGTGAACTACAGCCCCAGCAACGAAGCCCAC

TGGCCTAGATATCCTCACCTGTGGGTCCGACTGTACGTGC

TGGAACTGTACTGCATCATCCTGGGCCTGCCTCCATGCCT

GAACATCCTGAGAAGAAAGCAGCCTCAGCTGACCTTCTTC

ACAATCGCCCTGCAGAGCTGCCACTACCAGAGACTGCCTC

CACACATCCTGTGGGCCACCGGACTTAAGGGCTCTTCTGG

ATCTGAAACACCTGGCACAAGTGAGAGCGCCACCCCTGAG

AGCTCTGGCGGCAAGGCTACCGCCAAGTACTTCTTCTACA

GCAACATCATGAACTTTTTCAAGACCGAGATTACCCTGGC

CAACGGCGAGATCCGGAAGCGGCCTCTGATCGAGACAAAC

GGCGAAACCGGGGAGATCGTGTGGGATAAGGGCCGGGATT

TTGCCACCGTGCGGAAAGTGCTGAGCATGCCCCAAGTGAA

TATCGTGAAAAAGACCGAGGTGCAGACAGGCGGCTTCAGC

AAAGAGTCTATCCTGCCCAAGAGGAACAGCGATAAGCTGA

TCGCCAGAAAGAAGGACTGGGACCCTAAGAAGTACGGCGG

CTTCGACAGCCCCACCGTGGCCTATTCTGTGCTGGTGGTG

GCCAAAGTGGAAAAGGGCAAGTCCAAGAAACTGAAGAGTG

TGAAAGAGCTGCTGGGGATCACCATCATGGAAAGAAGCAG

CTTCGAGAAGAATCCCATCGACTTTCTGGAAGCCAAGGGC

TACAAAGAAGTGAAAAAGGACCTGATCATCAAGCTGCCTA

AGTACTCCCTGTTCGAGCTGGAAAACGGCCGGAAGAGAAT

GCTGGCCTCTGCCGGCGAACTGCAGAAGGGAAACGAACTG

GCCCTGCCCTCCAAATATGTGAACTTCCTGTACCTGGCCA

GCCACTATGAGAAGCTGAAGGGCTCCCCCGAGGATAATGA

GCAGAAACAGCTGTTTGTGGAACAGCACAAGCACTACCTG

GACGAGATCATCGAGCAGATCAGCGAGTTCTCCAAGAGAG

TGATCCTGGCCGACGCTAATCTGGACAAAGTGCTGTCCGC

CTACAACAAGCACCGGGATAAGCCCATCAGAGAGCAGGCC

GAGAATATCATCCACCTGTTTACCCTGACCAATCTGGGAG
```

-continued

```
CCCCTGCCGCCTTCAAGTACTTTGACACCACCATCGACCG

GAAGAGGTACACCAGCACCAAAGAGGTGCTGGACGCCACC

CTGATCCACCAGAGCATCACCGGCCTGTACGAGACACGGA

TCGACCTGTCTCAGCTGGGAGGTGACTCTGGTGGAAGCGG

AGGATCTGGCGGCAGCACCAATCTGAGCGACATCATCGAG

AAAGAGACAGGCAAGCAGCTGGTCATCCAAGAGTCCATCC

TGATGCTGCCTGAAGAGGTGGAAGAAGTGATCGGCAACAA

GCCCGAGTCCGACATCCTGGTGCACACCGCCTACGATGAG

AGCACCGACGAGAACGTGATGCTGCTGACCTCTGACGCCC

CTGAGTACAAGCCTTGGGCTCTCGTGATCCAGGACAGCAA

CGGCGAGAACAAGATCAAGATGCTGAGCGGCGGCTCTGGT

GGCTCTGGCGGATCTACAAACCTGTCCGATATTATTGAGA

AAGAAACCGGGAAACAGCTCGTGATTCAAGAGTCTATTCT

CATGCTCCCGGAAGAAGTCGAGGAAGTCATTGGAAACAAG

CCTGAGAGCGATATTCTGGTCCATACAGCCTACGACGAGT

CTACCGATGAGAATGTCATGCTCCTCACCAGCGACGCTCC

CGAGTATAAGCCATGGGCACTTGTCATTCAGGACTCCAAT

GGGGAAAACAAAATCAAAATGCTCCCAAAGAAAAAACGCA

AGGTGGAGGGAGCTGATAAGCGCACCGCCGATGGTTCCGA

GTTCGAAAGCCCCAAGAAGAAGAGGAAAGTCTAACCGGTC

ATCATCACCATCACCATTGAGTTTAAACCCGCTGATCAGC

CTCGACTGTGCCTTCTAGTTGCCAGCCATCTGTTGTTTGC

CCCTCCCCCGTGCCTTCCTTGACCCTGGAAGGTGCCACTC

CCACTGTCCTTTCCTAATAAAATGAGGAAATTGCATCGCA

TTGTCTGAGTAGGTGTCATTCTATTCTGGGGGGTGGGGTG

GGGCAGGACAGCAAGGGGGAGGATTGGGAAGACAATAGCA

GGCATGCTGGGGATGCGGTGGGCTCTATGGCTTCTGAGGC

GGAAAGAACCAGCTGGGGCTCGATACCGTCGACCTCTAGC

TAGAGCTTGGCGTAATCATGGTCATAGCTGTTTCCTGTGT

GAAATTGTTATCCGCTCACAATTCCACACAACATACGAGC

CGGAAGCATAAAGTGTAAAGCCTAGGGTGCCTAATGAGTG

AGCTAACTCACATTAATTGCGTTGCGCTCACTGCCCGCTT

TCCAGTCGGGAAACCTGTCGTGCCAGCTGCATTAATGAAT

CGGCCAACGCGCGGGGAGAGGCGGTTTGCGTATTGGGCGC

TCTTCCGCTTCCTCGCTCACTGACTCGCTGCGCTCGGTCG

TTCGGCTGCGGCGAGCGGTATCAGCTCACTCAAAGGCGGT

AATACGGTTATCCACAGAATCAGGGGATAACGCAGGAAAG

AACATGTGAGCAAAAGGCCAGCAAAAGGCCAGGAACCGTA

AAAAGGCCGCGTTGCTGGCGTTTTTCCATAGGCTCCGCCC

CCCTGACGAGCATCACAAAAATCGACGCTCAAGTCAGAGG
```

-continued

```
TGGCGAAACCCGACAGGACTATAAAGATACCAGGCGTTTC

CCCCTGGAAGCTCCCTCGTGCGCTCTCCTGTTCCGACCCT

GCCGCTTACCGGATACCTGTCCGCCTTTCTCCCTTCGGGA

AGCGTGGCGCTTTCTCATAGCTCACGCTGTAGGTATCTCA

GTTCGGTGTAGGTCGTTCGCTCCAAGCTGGGCTGTGTGCA

CGAACCCCCCGTTCAGCCCGACCGCTGCGCCTTATCCGGT

AACTATCGTCTTGAGTCCAACCCGGTAAGACACGACTTAT

CGCCACTGGCAGCAGCCACTGGTAACAGGATTAGCAGAGC

GAGGTATGTAGGCGGTGCTACAGAGTTCTTGAAGTGGTGG

CCTAACTACGGCTACACTAGAAGAACAGTATTTGGTATCT

GCGCTCTGCTGAAGCCAGTTACCTTCGGAAAAAGAGTTGG

TAGCTCTTGATCCGGCAAACAAACCACCGCTGGTAGCGGT

GGTTTTTTTGTTTGCAAGCAGCAGATTACGCGCAGAAAAA

AAGGATCTCAAGAAGATCCTTTGATCTTTTCTACGGGGTC

TGACGCTCAGTGGAACGAAAACTCACGTTAAGGGATTTTG

GTCATGAGATTATCAAAAAGGATCTTCACCTAGATCCTTT

TAAATTAAAAATGAAGTTTTAAATCAATCTAAAGTATATA

TGAGTAAACTTGGTCTGACAGTTACCAATGCTTAATCAGT

GAGGCACCTATCTCAGCGATCTGTCTATTTCGTTCATCCA

TAGTTGCCTGACTCCCCGTCGTGTAGATAACTACGATACG

GGAGGGCTTACCATCTGGCCCCAGTGCTGCAATGATACCG

CGAGACCCACGCTCACCGGCTCCAGATTTATCAGCAATAA

ACCAGCCAGCCGGAAGGGCCGAGCGCAGAAGTGGTCCTGC

AACTTTATCCGCCTCCATCCAGTCTATTAATTGTTGCCGG

GAAGCTAGAGTAAGTAGTTCGCCAGTTAATAGTTTGCGCA

ACGTTGTTGCCATTGCTACAGGCATCGTGGTGTCACGCTC

GTCGTTTGGTATGGCTTCATTCAGCTCCGGTTCCCAACGA

TCAAGGCGAGTTACATGATCCCCCATGTTGTGCAAAAAAG

CGGTTAGCTCCTTCGGTCCTCCGATCGTTGTCAGAAGTAA

GTTGGCCGCAGTGTTATCACTCATGGTTATGGCAGCACTG

CATAATTCTCTTACTGTCATGCCATCCGTAAGATGCTTTT

CTGTGACTGGTGAGTACTCAACCAAGTCATTCTGAGAATA

GTGTATGCGGCGACCGAGTTGCTCTTGCCCGGCGTCAATA

CGGGATAATACCGCGCCACATAGCAGAACTTTAAAAGTGC

TCATCATTGGAAAACGTTCTTCGGGGCGAAAACTCTCAAG

GATCTTACCGCTGTTGAGATCCAGTTCGATGTAACCCACT

CGTGCACCCAACTGATCTTCAGCATCTTTTACTTTCACCA

GCGTTTCTGGGTGAGCAAAAACAGGAAGGCAAAATGCCGC

AAAAAAGGGAATAAGGGCGACACGGAAATGTTGAATACTC

ATACTCTTCCTTTTTCAATATTATTGAAGCATTTATCAGG

GTTATTGTCTCATGAGCGGATACATATTTGAATGTATTTA
```

GAAAAATAAACAAATAGGGGTTCCGCGCACATTTCCCCGA

AAAGTGCCACCTGACGTCGACGGATCGGGAGATCGATCTC

CCGATCCCCTAGGGTCGACTCTCAGTACAATCTGCTCTGA

TGCCGCATAGTTAAGCCAGTATCTGCTCCCTGCTTGTGTG

TTGGAGGTCGCTGAGTAGTGCGCGAGCAAAATTTAAGCTA

CAACAAGGCAAGGCTTGACCGACAATTGCATGAGAATCT

GCTTAGGGTTAGGCGTTTTGCGCTGCTTCGCGATGTACGG

GCCAGATATACGCGTTGACATTGATTATTGACTAGTTATT

AATAGTAATCAATTACGGGGTCATTAGTTCATAGCCCATA

TATGGAGTTCCGCGTTACATAACTTACGGTAAATGGCCCG

CCTGGCTGACCGCCCAACGACCCCCGCCCATTGACGTCAA

TAATGACGTATGTTCCCATAGTAACGCCAATAGGGACTTT

CCATTGACGTCAATGGGTGGAGTATTTACGGTAAACTGCC

CACTTGGCAGTACATCAAGTGTATCATATGCCAAGTACGC

CCCCTATTGACGTCAATGACGGTAAATGGCCCGCCTGGCA

TTATGCCCAGTACATGACCTTATGGGACTTTCCTACTTGG

CAGTACATCTACGTATTAGTCATCGCTATTACCATGGTGA

TGCGGTTTTGGCAGTACATCAATGGGCGTGGATAGCGGTT

TGACTCACGGGGATTTCCAAGTCTCCACCCCATTGACGTC

AATGGGAGTTTGTTTTGGCACCAAAATCAACGGGACTTTC

CAAAATGTCGTAACAACTCCGCCCCATTGACGCAAATGGG

CGGTAGGCGTGTACGGTGGGAGGTCTATATAAGCAGAGCT

GGTTTAGTGAACCGTCAGATCCGCTAGAGATCCGCGGCCG

CTAATACGACTCACTATAGGGAGAGCCGCCACC pHRB-045_GGS-rAP: rAPOBEC1-XTEN-ins-
site3_E1029-D10A-UGIx2
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFEIRLEESFLVEEDKKHERHPIF

GNIVDEVAYHEKYPTIYHLRKKLVDSTDKADLRLIYLALA

HMIKFRGHFLIEGDLNPDNSDVDKLFIQLVQTYNQLFEEN

PINASGVDAKAILSARLSKSRRLENLIAQLPGEKKNGLFG

NLIALSLGLTPNFKSNFDLAEDAKLQLSKDTYDDDLDNLL

AQIGDQYADLFLAAKNLSDAILLSDILRVNTEITKAPLSA

SMIKRYDEHHQDLTLLKALVRQQLPEKYKEIFFDQSKNGY

AGYIDGGASQEEFYKFIKPILEKMDGTEELLVKLNREDLL

RKQRTFDNGSIPHQIHLGELHAILRRQEDFYPFLKDNREK

IEKILTFRIPYYVGPLARGNSRFAWMTRKSEETITPWNFE

EVVDKGASAQSFIERMTNFDKNLPNEKVLPKHSLLYEYFT

VYNELTKVKYVTEGMRKPAFLSGEQKKAIVDLLFKTNRKV

TVKQLKEDYFKKIECFDSVETSGVEDRFNASLGTYHDLLK

IIKDKDFLDNEENEDILEDIVLTLTLFEDREMIEERLKTY

AHLFDDKVMKQLKRRRYTGWGRLSRKLINGIRDKQSGKTI

LDFLKSDGFANRNFMQLIHDDSLTFKEDIQKAQVSGQGDS

LHEHIANLAGSPAIKKGILQTVKVVDELVKVMGRHKPENI

VIEMARENQTTQKGQKNSRERMKRIEEGIKELGSQILKEH

PVENTQLQNEKLYLYYLQNGRDMYVDQELDINRLSDYDVD

HIVPQSFLKDDSIDNKVLTRSDKNRGKSDNVPSEEVVKKM

KNYWRQLLNAKLITQRKFDNLTKAERGGLSELDKAGFIKR

QLVETRQITKHVAQILDSRMNTKYDENDKLIREVKVITLK

SKLVSDFRKDFQFYKVREINNYHHAHDAYLNAVVGTALIK

KYPKLESEFVYGDYKVYDVRKMIAKSEQEIGGSGGSSSET

GPVAVDPTLRRRIEPHEFEVFFDPRELRKETCLLYEINWG

GRHSIWRHTSQNTNKHVEVNFIEKFTTERYFCPNTRCSIT

WFLSWSPCGECSRAITEFLSRYPHVTLFIYIARLYHHADP

RNRQGLRDLISSGVTIQIMTEQESGYCWRNFVNYSPSNEA

HWPRYPHLWVRLYVLELYCIILGLPPCLNILRRKQPQLTF

FTIALQSCHYQRLPPHILWATGLKGSSGSETPGTSESATP

ESSGGKATAKYFFYSNIMNFFKTEITLANGEIRKRPLIET

NGETGEIVWDKGRDFATVRKVLSMPQVNIVKKTEVQTGGF

SKESILPKRNSDKLIARKKDWDPKKYGGFDSPTVAYSVLV

VAKVEKGKSKKLKSVKELLGITIMERSSFEKNPIDFLEAK

GYKEVKKDLIIKLPKYSLFELENGRKRMLASAGELQKGNE

LALPSKYVNFLYLASHYEKLKGSPEDNEQKQLFVEQHKHY

LDEIIEQISEFSKRVILADANLDKVLSAYNKHRDKPIREQ

AENIIHLFTLTNLGAPAAFKYFDTTIDRKRYTSTKEVLDA

TLIHQSITGLYETRIDLSQLGGDSGGSGGSGGGSTNLSDII

EKETGKQLVIQESILMLPEEVEEVIGNKPESDILVHTAYD

ESTDENVMLLTSDAPEYKPWALVIQDSNGENKIKMLSGGS

GGSGGSTNLSDIIEKETGKQLVIQESILMLPEEVEEVIGN

KPESDILVHTAYDESTDENVMLLTSDAPEYKPWALVIQDS

NGENKIKMLPKKKRKVEGADKRTADGSEFESPKKKRKV*

OMB-046_GGS-rAP: rAPOBEC1-XTEN-
ins-site4_N1040-D10A-UGIx2
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

-continued

```
AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC
```

-continued

```
GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGGAAGATGATCGCCAAGAGCGAGCA

GGAAATCGGCAAGGCTACCGCCAAGTACTTCTTCTACAGC

AACGGAGGCTCTGGAGGAAGCAGCTCTGAGACAGGACCTG

TGGCCGTGGATCCCACACTGCGGGAGAAGAATTGAGCCCCA

CGAGTTCGAGGTGTTCTTCGACCCCAGAGAGCTGCGGAAA

GAGACATGCCTGCTGTACGAGATCAACTGGGGCGGCAGAC

ACTCTATCTGGCGGCACACAAGCCAGAACACCAACAAGCA

CGTGGAAGTGAACTTTATCGAGAAGTTTACGACCGAGCGG

TACTTCTGCCCCAACACCAGATGCAGCATCACCTGGTTTC

TGAGCTGGTCCCCTTGCGGCGAGTGCAGCAGAGCCATCAC

CGAGTTTCTGTCCAGATATCCCCACGTGACCCTGTTCATC

TATATCGCCCGGCTGTACCACCACGCCGATCCTAGAAATA

GACAGGGCCTGCGCGACCTGATCAGCAGCGGAGTGACAAT

CCAGATCATGACCGAGCAAGAGAGCGGCTACTGCTGGCGG
```

Line numbers in margin: 5, 10, 15, 20, 25, 30, 35, 40, 45, 50, 55, 60, 65

-continued

```
AACTTCGTGAACTACAGCCCCAGCAACGAAGCCCACTGGC
CTAGATATCCTCACCTGTGGGTCCGACTGTACGTGCTGGA
ACTGTACTGCATCATCCTGGGCCTGCCTCCATGCCTGAAC
ATCCTGAGAAGAAAGCAGCCTCAGCTGACCTTCTTCACAA
TCGCCCTGCAGAGCTGCCACTACCAGAGACTGCCTCCACA
CATCCTGTGGGCCACCGGACTTAAGGGCTCTTCTGGATCT
GAAACACCTGGCACAAGTGAGAGCGCCACCCCTGAGAGCT
CTGGCATCATGAACTTTTTCAAGACCGAGATTACCCTGGC
CAACGGCGAGATCCGGAAGCGGCCTCTGATCGAGACAAAC
GGCGAAACCGGGGAGATCGTGTGGGATAAGGGCCGGGATT
TTGCCACCGTGCGGAAAGTGCTGAGCATGCCCCAAGTGAA
TATCGTGAAAAAGACCGAGGTGCAGACAGGCGGCTTCAGC
AAAGAGTCTATCCTGCCCAAGAGGAACAGCGATAAGCTGA
TCGCCAGAAAGAAGGACTGGGACCCTAAGAAGTACGGCGG
CTTCGACAGCCCCACCGTGGCCTATTCTGTGCTGGTGGTG
GCCAAAGTGGAAAAGGGCAAGTCCAAGAAACTGAAGAGTG
TGAAAGAGCTGCTGGGGATCACCATCATGGAAAGAAGCAG
CTTCGAGAAGAATCCCATCGACTTTCTGGAAGCCAAGGGC
TACAAAGAAGTGAAAAAGGACCTGATCATCAAGCTGCCTA
AGTACTCCCTGTTCGAGCTGGAAAACGGCCGGAAGAGAAT
GCTGGCCTCTGCCGGCGAACTGCAGAAGGGAAACGAACTG
GCCCTGCCCTCCAAATATGTGAACTTCCTGTACCTGGCCA
GCCACTATGAGAAGCTGAAGGGCTCCCCCGAGGATAATGA
GCAGAAACAGCTGTTTGTGGAACAGCACAAGCACTACCTG
GACGAGATCATCGAGCAGATCAGCGAGTTCTCCAAGAGAG
TGATCCTGGCCGACGCTAATCTGGACAAAGTGCTGTCCGC
CTACAACAAGCACCGGGATAAGCCCATCAGAGAGCAGGCC
GAGAATATCATCCACCTGTTTACCCTGACCAATCTGGGAG
CCCCTGCCGCCTTCAAGTACTTTGACACCACCATCGACCG
GAAGAGGTACACCAGCACCAAAGAGGTGCTGGACGCCACC
CTGATCCACCAGAGCATCACCGGCCTGTACGAGACACGGA
TCGACCTGTCTCAGCTGGGAGGTGACTCTGGTGGAAGCGG
AGGATCTGGCGGCAGCACCAATCTGAGCGACATCATCGAG
AAAGAGACAGGCAAGCAGCTGGTCATCCAAGAGTCCATCC
TGATGCTGCCTGAAGAGGTGGAAGAAGTGATCGGCAACAA
GCCCGAGTCCGACATCCTGGTGCACACCGCCTACGATGAG
AGCACCGACGAGAACGTGATGCTGCTGACCTCTGACGCCC
CTGAGTACAAGCCTTGGGCTCTCGTGATCCAGGACAGCAA
CGGCGAGAACAAGATCAAGATGCTGAGCGGCGGCTCTGGT
GGCTCTGGCGGATCTACAAACCTGTCCGATATTATTGAGA
```

-continued

```
AAGAAACCGGGAAACAGCTCGTGATTCAAGAGTCTATTCT
CATGCTCCCGGAAGAAGTCGAGGAAGTCATTGGAAACAAG
CCTGAGAGCGATATTCTGGTCCATACAGCCTACGACGAGT
CTACCGATGAGAATGTCATGCTCCTCACCAGCGACGCTCC
CGAGTATAAGCCATGGGCACTTGTCATTCAGGACTCCAAT
GGGGAAAACAAAATCAAAATGCTCCCAAAGAAAAAACGCA
AGGTGGAGGGAGCTGATAAGCGCACCGCCGATGGTTCCGA
GTTCGAAAGCCCCAAGAAGAAGAGGAAAGTCTAACCGGTC
ATCATCACCATCACCATTGAGTTTAAACCCGCTGATCAGC
CTCGACTGTGCCTTCTAGTTGCCAGCCATCTGTTGTTTGC
CCCTCCCCCGTGCCTTCCTTGACCCTGGAAGGTGCCACTC
CCACTGTCCTTTCCTAATAAAATGAGGAAATTGCATCGCA
TTGTCTGAGTAGGTGTCATTCTATTCTGGGGGGTGGGGTG
GGGCAGGACAGCAAGGGGGAGGATTGGGAAGACAATAGCA
GGCATGCTGGGGATGCGGTGGGCTCTATGGCTTCTGAGGC
GGAAAGAACCAGCTGGGGCTCGATACCGTCGACCTCTAGC
TAGAGCTTGGCGTAATCATGGTCATAGCTGTTTCCTGTGT
GAAATTGTTATCCGCTCACAATTCCACACAACATACGAGC
CGGAAGCATAAAGTGTAAAGCCTAGGGTGCCTAATGAGTG
AGCTAACTCACATTAATTGCGTTGCGCTCACTGCCCGCTT
TCCAGTCGGGAAACCTGTCGTGCCAGCTGCATTAATGAAT
CGGCCAACGCGCGGGGAGAGGCGGTTTGCGTATTGGGCGC
TCTTCCGCTTCCTCGCTCACTGACTCGCTGCGCTCGGTCG
TTCGGCTGCGGCGAGCGGTATCAGCTCACTCAAAGGCGGT
AATACGGTTATCCACAGAATCAGGGGATAACGCAGGAAAG
AACATGTGAGCAAAAGGCCAGCAAAAGGCCAGGAACCGTA
AAAAGGCCGCGTTGCTGGCGTTTTTCCATAGGCTCCGCCC
CCCTGACGAGCATCACAAAAATCGACGCTCAAGTCAGAGG
TGGCGAAACCCGACAGGACTATAAAGATACCAGGCGTTTC
CCCCTGGAAGCTCCCTCGTGCGCTCTCCTGTTCCGACCCT
GCCGCTTACCGGATACCTGTCCGCCTTTCTCCCTTCGGGA
AGCGTGGCGCTTTCTCATAGCTCACGCTGTAGGTATCTCA
GTTCGGTGTAGGTCGTTCGCTCCAAGCTGGGCTGTGTGCA
CGAACCCCCCGTTCAGCCCGACCGCTGCGCCTTATCCGGT
AACTATCGTCTTGAGTCCAACCCGGTAAGACACGACTTAT
CGCCACTGGCAGCAGCCACTGGTAACAGGATTAGCAGAGC
GAGGTATGTAGGCGGTGCTACAGAGTTCTTGAAGTGGTGG
CCTAACTACGGCTACACTAGAAGAACAGTATTTGGTATCT
GCGCTCTGCTGAAGCCAGTTACCTTCGGAAAAAGAGTTGG
TAGCTCTTGATCCGGCAAACAAACCACCGCTGGTAGCGGT
GGTTTTTTTGTTTGCAAGCAGCAGATTACGCGCAGAAAAA
```

-continued

```
AAGGATCTCAAGAAGATCCTTTGATCTTTTCTACGGGGTC

TGACGCTCAGTGGAACGAAAACTCACGTTAAGGGATTTTG

GTCATGAGATTATCAAAAAGGATCTTCACCTAGATCCTTT

TAAATTAAAAATGAAGTTTTAAATCAATCTAAAGTATATA

TGAGTAAACTTGGTCTGACAGTTACCAATGCTTAATCAGT

GAGGCACCTATCTCAGCGATCTGTCTATTTCGTTCATCCA

TAGTTGCCTGACTCCCCGTCGTGTAGATAACTACGATACG

GGAGGGCTTACCATCTGGCCCCAGTGCTGCAATGATACCG

CGAGACCCACGCTCACCGGCTCCAGATTTATCAGCAATAA

ACCAGCCAGCCGGAAGGGCCGAGCGCAGAAGTGGTCCTGC

AACTTTATCCGCCTCCATCCAGTCTATTAATTGTTGCCGG

GAAGCTAGAGTAAGTAGTTCGCCAGTTAATAGTTTGCGCA

ACGTTGTTGCCATTGCTACAGGCATCGTGGTGTCACGCTC

GTCGTTTGGTATGGCTTCATTCAGCTCCGGTTCCCAACGA

TCAAGGCGAGTTACATGATCCCCCATGTTGTGCAAAAAG

CGGTTAGCTCCTTCGGTCCTCCGATCGTTGTCAGAAGTAA

GTTGGCCGCAGTGTTATCACTCATGGTTATGGCAGCACTG

CATAATTCTCTTACTGTCATGCCATCCGTAAGATGCTTTT

CTGTGACTGGTGAGTACTCAACCAAGTCATTCTGAGAATA

GTGTATGCGGCGACCGAGTTGCTCTTGCCCGGCGTCAATA

CGGGATAATACCGCGCCACATAGCAGAACTTTAAAAGTGC

TCATCATTGGAAAACGTTCTTCGGGGCGAAAACTCTCAAG

GATCTTACCGCTGTTGAGATCCAGTTCGATGTAACCCACT

CGTGCACCCAACTGATCTTCAGCATCTTTTACTTTCACCA

GCGTTTCTGGGTGAGCAAAAACAGGAAGGCAAAATGCCGC

AAAAAAGGGAATAAGGGCGACACGGAAATGTTGAATACTC

ATACTCTTCCTTTTTCAATATTATTGAAGCATTTATCAGG

GTTATTGTCTCATGAGCGGATACATATTTGAATGTATTTA

GAAAAATAAACAAATAGGGGTTCCGCGCACATTTCCCCGA

AAAGTGCCACCTGACGTCGACGGATCGGGAGATCGATCTC

CCGATCCCCTAGGGTCGACTCTCAGTACAATCTGCTCTGA

TGCCGCATAGTTAAGCCAGTATCTGCTCCCTGCTTGTGTG

TTGGAGGTCGCTGAGTAGTGCGCGAGCAAAATTTAAGCTA

CAACAAGGCAAGGCTTGACCGACAATTGCATGAAGAATCT

GCTTAGGGTTAGGCGTTTTGCGCTGCTTCGCGATGTACGG

GCCAGATATACGCGTTGACATTGATTATTGACTAGTTATT

AATAGTAATCAATTACGGGGTCATTAGTTCATAGCCCATA

TATGGAGTTCCGCGTTACATAACTTACGGTAAATGGCCCG

CCTGGCTGACCGCCCAACGACCCCCGCCCATTGACGTCAA

TAATGACGTATGTTCCCATAGTAACGCCAATAGGGACTTT
```

-continued

```
CCATTGACGTCAATGGGTGGAGTATTTACGGTAAACTGCC

CACTTGGCAGTACATCAAGTGTATCATATGCCAAGTACGC

CCCCTATTGACGTCAATGACGGTAAATGGCCCGCCTGGCA

TTATGCCCAGTACATGACCTTATGGGACTTTCCTACTTGG

CAGTACATCTACGTATTAGTCATCGCTATTACCATGGTGA

TGCGGTTTTGGCAGTACATCAATGGGCGTGGATAGCGGTT

TGACTCACGGGGATTTCCAAGTCTCCACCCCATTGACGTC

AATGGGAGTTTGTTTTGGCACCAAAATCAACGGGACTTTC

CAAAATGTCGTAACAACTCCGCCCCATTGACGCAAATGGG

CGGTAGGCGTGTACGGTGGGAGGTCTATATAAGCAGAGCT

GGTTTAGTGAACCGTCAGATCCGCTAGAGATCCGCGGCCG

CTAATACGACTCACTATAGGGAGAGCCGCCACC
``` pHRB-046_GGS-rAP: rAPOBEC1-XTEN-
ins-site4_N1040-D10A-UGIx2

```
MDKKYSIGLAIGTNSVGWAVITDEYKVPSKKFKVLGNTDRHS

IKKNLIGALLFDSGETAEATRLKRTARRRYTRRKNRICYLQ

EIFSNEMAKVDDSFFHRLEESFLVEEDKKHERHPIFGNIV

DEVAYHEKYPTIYHLRKKLVDSTDKADLRLIYLALAHMIK

FRGHFLIEGDLNPDNSDVDKLFIQLVQTYNQLFEENPINA

SGVDAKAILSARLSKSRRLENLIAQLPGEKKNGLFGNLIA

LSLGLTPNFKSNFDLAEDAKLQLSKDTYDDDLDNLLAQIG

DQYADLFLAAKNLSDAILLSDILRVNTEITKAPLSASMIK

RYDEHHQDLTLLKALVRQQLPEKYKEIFFDQSKNGYAGYI

DGGASQEEFYKFIKPILEKMDGTEELLVKLNREDLLRKQR

TFDNGSIPHQIHLGELHAILRRQEDFYPFLKDNREKIEKI

LTFRIPYYVGPLARGNSRFAWMTRKSEETITPWNFEEVVD

KGASAQSFIERNITNFDKNLPNEKVLPKHSLLYEYFTVYN

ELTKVKYVTEGMRKPAFLSGEQKKAIVDLLFKTNRKVTVK

QLKEDYFKKIECFDSVETSGVEDRFNASLGTYHDLLKIIK

DKDFLDNEENEDILEDIVLTLTLFEDREMIEERLKTYAHL

FDDKVMKQLKRRRYTGWGRLSRKLINGIRDKQSGKTILDF

LKSDGFANRNFMQLIHDDSLTFKEDIQKAQVSGQGDSLHE

HIANLAGSPAIKKGILQTVKVVDELVKVMGRHKPENIVIE

MARENQTTQKGQKNSRERMKRIEEGIKELGSQILKEHPVE

NTQLQNEKLYLYYLQNGRDMYVDQELDINRLSDYDVDHIV

PQSFLKDDSIDNKVLTRSDKNRGKSDNVPSEEVVKKM

KNYWRQLLNAKLITQRKFDNLTKAERGGLSELDKAGFIKR

QLVETRQITKHVAQILDSRMNTKYDENDKLIREVKVITLK

SKLVSDFRKDFQFYKVREINNYHHAHDAYLNAVVGTALIK

KYPKLESEFVYGDYKVYDVRKMIAKSEQEIGKATAKYFFY

SNGGSGGSSSETGPVAVDPTLRRRIEPHEFEVFFDPRELR

KETCLLYEINWGGRHSIWRHTSQNTNKHVEVNFIEKFTTE
```

-continued

```
RYFCPNTRCSITWFLSWSPCGECSRAITEFLSRYPHVTLF

IYIARLYHHADPRNRQGLRDLISSGVTIQIMTEQESGYCW

RNFVNYSPSNEAHWPRYPHLWVRLYVLELYCIILGLPPCL

NILRRKQPQLTFFTIALQSCHYQRLPPHILWATGLKGSSG

SETPGTSESATPESSGIMNFFKTEITLANGEIRKRPLIET

NGETGEIVWDKGRDFATVRKVLSMPQVNIVKKTEVQTGGF

SKESILPKRNSDKLIARKKDWDPKKYGGFDSPTVAYSVLV

VAKVEKGKSKKLKSVKELLGITIMERSSFEKNPIDFLEAK

GYKEVKKDLIIKLPKYSLFELENGRKRMLASAGELQKGNE

LALPSKYVNFLYLASHYEKLKGSPEDNEQKQLFVEQHKHY

LDEIIEQISEFSKRVILADANLDKVLSAYNKHRDKPIREQ

AENIIHLFTLTNLGAPAAFKYFDTTIDRKRYTSTKEVLDA

TLIHQSITGLYETRIDLSQLGGDSGGSGGSGGSTNLSDII

EKETGKQLVIQESILMLPEEVEEVIGNKPESDILVHTAYD

ESTDENVMLLTSDAPEYKPWALVIQDSNGENKIKMLSGGS

GGSGGSTNLSDIIEKETGKQLVIQESILMLPEEVEEVIGN

KPESDILVHTAYDESTDENVMLLTSDAPEYKPWALVIQDS

NGENKIKMLPKKKRKVEGADKRTADGSEFESPKKKRKV* pHRB-047_GGS-rAP: rAPOBEC1-XTEN-
ins-site5-T1069-D10A-UGIx2
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC
```

-continued

```
CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA
```

5

10

15

20

25

30

35

40

45

50

55

60

65

-continued

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGGAAGATGATCGCCAAGAGCGAGCA

GGAAATCGGCAAGGCTACCGCCAAGTACTTCTTCTACAGC

AACATCATGAACTTTTTCAAGACCGAGATTACCCTGGCCA

ACGGCGAGATCCGGAAGCGGCCTCTGATCGAGACAAACGG

CGAAACCGGAGGCTCTGGAGGAAGCAGCTCTGAGACAGGA

CCTGTGGCCGTGGATCCCACACTGCGGAGAAGAATTGAGC

CCCACGAGTTCGAGGTGTTCTTCGACCCCAGAGAGCTGCG

GAAAGAGACATGCCTGCTGTACGAGATCAACTGGGGCGGC

AGACACTCTATCTGGCGGCACACAAGCCAGAACACCAACA

AGCACGTGGAAGTGAACTTTATCGAGAAGTTTACGACCGA

GCGGTACTTCTGCCCCAACACCAGATGCAGCATCACCTGG

TTTCTGAGCTGGTCCCCTTGCGGCGAGTGCAGCAGAGCCA

TCACCGAGTTTCTGTCCAGATATCCCCACGTGACCCTGTT

CATCTATATCGCCCGGCTGTACCACCACGCCGATCCTAGA

AATAGACAGGGCCTGCGCGACCTGATCAGCAGCGGAGTGA

CAATCCAGATCATGACCGAGCAAGAGAGCGGCTACTGCTG

GCGGAACTTCGTGAACTACAGCCCCAGCAACGAAGCCCAC

TGGCCTAGATATCCTCACCTGTGGGTCCGACTGTACGTGC

TGGAACTGTACTGCATCATCCTGGGCCTGCCTCCATGCCT

GAACATCCTGAGAAGAAAGCAGCCTCAGCTGACCTTCTTC

ACAATCGCCCTGCAGAGCTGCCACTACCAGAGACTGCCTC

CACACATCCTGTGGGCCACCGGACTTAAGGGCTCTTCTGG

ATCTGAAACACCTGGCACAAGTGAGAGCGCCACCCCTGAG

AGCTCTGGCGGGGAGATCGTGTGGGATAAGGGCCGGGATT

TTGCCACCGTGCGGAAAGTGCTGAGCATGCCCCAAGTGAA

TATCGTGAAAAAGACCGAGGTGCAGACAGGCGGCTTCAGC

-continued

AAAGAGTCTATCCTGCCCAAGAGGAACAGCGATAAGCTGA

TCGCCAGAAAGAAGGACTGGGACCCTAAGAAGTACGGCGG

CTTCGACAGCCCCACCGTGGCCTATTCTGTGCTGGTGGTG

GCCAAAGTGGAAAAGGGCAAGTCCAAGAAACTGAAGAGTG

TGAAAGAGCTGCTGGGGATCACCATCATGGAAAGAAGCAG

CTTCGAGAAGAATCCCATCGACTTTCTGGAAGCCAAGGGC

TACAAAGAAGTGAAAAAGGACCTGATCATCAAGCTGCCTA

AGTACTCCCTGTTCGAGCTGGAAAACGGCCGGAAGAGAAT

GCTGGCCTCTGCCGGCGAACTGCAGAAGGGAAACGAACTG

GCCCTGCCCTCCAAATATGTGAACTTCCTGTACCTGGCCA

GCCACTATGAGAAGCTGAAGGGCTCCCCCGAGGATAATGA

GCAGAAACAGCTGTTTGTGGAACAGCACAAGCACTACCTG

GACGAGATCATCGAGCAGATCAGCGAGTTCTCCAAGAGAG

TGATCCTGGCCGACGCTAATCTGGACAAAGTGCTGTCCGC

CTACAACAAGCACCGGGATAAGCCCATCAGAGAGCAGGCC

GAGAATATCATCCACCTGTTTACCCTGACCAATCTGGGAG

CCCCTGCCGCCTTCAAGTACTTTGACACCACCATCGACCG

GAAGAGGTACACCAGCACCAAAGAGGTGCTGGACGCCACC

CTGATCCACCAGAGCATCACCGGCCTGTACGAGACACGGA

TCGACCTGTCTCAGCTGGGAGGTGACTCTGGTGGAAGCGG

AGGATCTGGCGGCAGCACCAATCTGAGCGACATCATCGAG

AAAGAGACAGGCAAGCAGCTGGTCATCCAAGAGTCCATCC

TGATGCTGCCTGAAGAGGTGGAAGAAGTGATCGGCAACAA

GCCCGAGTCCGACATCCTGGTGCACACCGCCTACGATGAG

AGCACCGACGAGAACGTGATGCTGCTGACCTCTGACGCCC

CTGAGTACAAGCCTTGGGCTCTCGTGATCCAGGACAGCAA

CGGCGAGAACAAGATCAAGATGCTGAGCGGCGGCTCTGGT

GGCTCTGGCGGATCTACAAACCTGTCCGATATTATTGAGA

AAGAAACCGGGAAACAGCTCGTGATTCAAGAGTCTATTCT

CATGCTCCCGGAAGAAGTCGAGGAAGTCATTGGAAACAAG

CCTGAGAGCGATATTCTGGTCCATACAGCCTACGACGAGT

CTACCGATGAGAATGTCATGCTCCTCACCAGCGACGCTCC

CGAGTATAAGCCATGGGCACTTGTCATTCAGGACTCCAAT

GGGGAAAACAAAATCAAAATGCTCCCAAAGAAAAAACGCA

AGGTGGAGGGAGCTGATAAGCGCACCGCCGATGGTTCCGA

GTTCGAAAGCCCCAAGAAGAAGAGGAAAGTCTAACCGGTC

ATCATCACCATCACCATTGAGTTTAAACCCGCTGATCAGC

CTCGACTGTGCCTTCTAGTTGCCAGCCATCTGTTGTTTGC

CCCTCCCCCGTGCCTTCCTTGACCCTGGAAGGTGCCACTC

CCACTGTCCTTTCCTAATAAAATGAGGAAATTGCATCGCA

TTGTCTGAGTAGGTGTCATTCTATTCTGGGGGGTGGGGTG

-continued

GGGCAGGACAGCAAGGGGGAGGATTGGGAAGACAATAGCA

GGCATGCTGGGGATGCGGTGGGCTCTATGGCTTCTGAGGC

GGAAAGAACCAGCTGGGGCTCGATACCGTCGACCTCTAGC

TAGAGCTTGGCGTAATCATGGTCATAGCTGTTTCCTGTGT

GAAATTGTTATCCGCTCACAATTCCACACAACATACGAGC

CGGAAGCATAAAGTGTAAAGCCTAGGGTGCCTAATGAGTG

AGCTAACTCACATTAATTGCGTTGCGCTCACTGCCCGCTT

TCCAGTCGGGAAACCTGTCGTGCCAGCTGCATTAATGAAT

CGGCCAACGCGCGGGGAGAGGCGGTTTGCGTATTGGGCGC

TCTTCCGCTTCCTCGCTCACTGACTCGCTGCGCTCGGTCG

TTCGGCTGCGGCGAGCGGTATCAGCTCACTCAAAGGCGGT

AATACGGTTATCCACAGAATCAGGGGATAACGCAGGAAAG

AACATGTGAGCAAAAGGCCAGCAAAAGGCCAGGAACCGTA

AAAAGGCCGCGTTGCTGGCGTTTTTCCATAGGCTCCGCCC

CCCTGACGAGCATCACAAAAATCGACGCTCAAGTCAGAGG

TGGCGAAACCCGACAGGACTATAAAGATACCAGGCGTTTC

CCCCTGGAAGCTCCCTCGTGCGCTCTCCTGTTCCGACCCT

GCCGCTTACCGGATACCTGTCCGCCTTTCTCCCTTCGGGA

AGCGTGGCGCTTTCTCATAGCTCACGCTGTAGGTATCTCA

GTTCGGTGTAGGTCGTTCGCTCCAAGCTGGGCTGTGTGCA

CGAACCCCCCGTTCAGCCCGACCGCTGCGCCTTATCCGGT

AACTATCGTCTTGAGTCCAACCCGGTAAGACACGACTTAT

CGCCACTGGCAGCAGCCACTGGTAACAGGATTAGCAGAGC

GAGGTATGTAGGCGGTGCTACAGAGTTCTTGAAGTGGTGG

CCTAACTACGGCTACACTAGAAGAACAGTATTTGGTATCT

GCGCTCTGCTGAAGCCAGTTACCTTCGGAAAAAGAGTTGG

TAGCTCTTGATCCGGCAAACAAACCACCGCTGGTAGCGGT

GGTTTTTTTGTTTGCAAGCAGCAGATTACGCGCAGAAAAA

AAGGATCTCAAGAAGATCCTTTGATCTTTTCTACGGGGTC

TGACGCTCAGTGGAACGAAAACTCACGTTAAGGGATTTTG

GTCATGAGATTATCAAAAAGGATCTTCACCTAGATCCTTT

TAAATTAAAAATGAAGTTTTAAATCAATCTAAAGTATATA

TGAGTAAACTTGGTCTGACAGTTACCAATGCTTAATCAGT

GAGGCACCTATCTCAGCGATCTGTCTATTTCGTTCATCCA

TAGTTGCCTGACTCCCCGTCGTGTAGATAACTACGATACG

GGAGGGCTTACCATCTGGCCCCAGTGCTGCAATGATACCG

CGAGACCCACGCTCACCGGCTCCAGATTTATCAGCAATAA

ACCAGCCAGCCGGAAGGGCCGAGCGCAGAAGTGGTCCTGC

AACTTTATCCGCCTCCATCCAGTCTATTAATTGTTGCCGG

GAAGCTAGAGTAAGTAGTTCGCCAGTTAATAGTTTGCGCA

ACGTTGTTGCCATTGCTACAGGCATCGTGGTGTCACGCTC

GTCGTTTGGTATGGCTTCATTCAGCTCCGGTTCCCAACGA

TCAAGGCGAGTTACATGATCCCCCATGTTGTGCAAAAAAG

CGGTTAGCTCCTTCGGTCCTCCGATCGTTGTCAGAAGTAA

GTTGGCCGCAGTGTTATCACTCATGGTTATGGCAGCACTG

CATAATTCTCTTACTGTCATGCCATCCGTAAGATGCTTTT

CTGTGACTGGTGAGTACTCAACCAAGTCATTCTGAGAATA

GTGTATGCGGCGACCGAGTTGCTCTTGCCCGGCGTCAATA

CGGGATAATACCGCGCCACATAGCAGAACTTTAAAAGTGC

TCATCATTGGAAAACGTTCTTCGGGGCGAAAACTCTCAAG

GATCTTACCGCTGTTGAGATCCAGTTCGATGTAACCCACT

CGTGCACCCAACTGATCTTCAGCATCTTTTACTTTCACCA

GCGTTTCTGGGTGAGCAAAAACAGGAAGGCAAAATGCCGC

AAAAAAGGGAATAAGGGCGACACGGAAATGTTGAATACTC

ATACTCTTCCTTTTTCAATATTATTGAAGCATTTATCAGG

GTTATTGTCTCATGAGCGGATACATATTTGAATGTATTTA

GAAAAATAAACAAATAGGGGTTCCGCGCACATTTCCCCGA

AAAGTGCCACCTGACGTCGACGGATCGGGAGATCGATCTC

CCGATCCCCTAGGGTCGACTCTCAGTACAATCTGCTCTGA

TGCCGCATAGTTAAGCCAGTATCTGCTCCCTGCTTGTGTG

TTGGAGGTCGCTGAGTAGTGCGCGAGCAAAATTTAAGCTA

CAACAAGGCAAGGCTTGACCGACAATTGCATGAAGAATCT

GCTTAGGGTTAGGCGTTTTGCGCTGCTTCGCGATGTACGG

GCCAGATATACGCGTTGACATTGATTATTGACTAGTTATT

AATAGTAATCAATTACGGGGTCATTAGTTCATAGCCCATA

TATGGAGTTCCGCGTTACATAACTTACGGTAAATGGCCCG

CCTGGCTGACCGCCCAACGACCCCCGCCCATTGACGTCAA

TAATGACGTATGTTCCCATAGTAACGCCAATAGGGACTTT

CCATTGACGTCAATGGGTGGAGTATTTACGGTAAACTGCC

CACTTGGCAGTACATCAAGTGTATCATATGCCAAGTACGC

CCCCTATTGACGTCAATGACGGTAAATGGCCCGCCTGGCA

TTATGCCCAGTACATGACCTTATGGGACTTTCCTACTTGG

CAGTACATCTACGTATTAGTCATCGCTATTACCATGGTGA

TGCGGTTTTGGCAGTACATCAATGGGCGTGGATAGCGGTT

TGACTCACGGGGATTTCCAAGTCTCCACCCCATTGACGTC

AATGGGAGTTTGTTTTGGCACCAAAATCAACGGGACTTTC

CAAAATGTCGTAACAACTCCGCCCCATTGACGCAAATGGG

-continued

CGGTAGGCGTGTACGGTGGGAGGTCTATATAAGCAGAGCT

GGTTTAGTGAACCGTCAGATCCGCTAGAGATCCGCGGCCG

CTAATACGACTCACTATAGGGAGAGCCGCCACC pHRB-047_GGS-rAP: rAPOBEC1-XTEN-
ins-site_5-Ti069-D10A-UGIx2
MDKKYSIGLAIGTNSVGWAVITDEYKVPSKKFKVLGNTDR

HSIKKNLIGALLFDSGETAEATRLKRTARRRYTRRKNRIC

YLQEIFSNEMAKVDDSFFHRLEESFLVEEDKKHERHPIFG

NIVDEVAYHEKYPTIYHLRKKLVDSTDKADLRLIYLALAH

MIKFRGHFLIEGDLNPDNSDVDKLFIQLVQTYNQLFEENP

INASGVDAKAILSARLSKSRRLENLIAQLPGEKKNGLFGN

LIALSLGLTPNFKSNFDLAEDAKLQLSKDTYDDDLDNLLA

QIGDQYADLFLAAKNLSDAILLSDILRVNTEITKAPLSAS

MIKRYDEHHQDLTLLKALVRQQLPEKYKEIFFDQSKNGYA

GYIDGGASQEEFYKFIKPILEKMDGTEELLVKLNREDLLR

KQRTFDNGSIPHQIHLGELHAILRRQEDFYPFLKDNREKI

EKILTFRIPYYVGPLARGNSRFAWMTRKSEETITPWNFEE

VVDKGASAQSFIERMTNFDKNLPNEKVLPKHSLLYEYFTV

YNELTKVKYVTEGMRKPAFLSGEQKKAIVDLLFKTNRKVT

VKQLKEDYFKKIECFDSVETSGVEDRFNASLGTYHDLLKI

IKDKDFLDNEENEDILEDIVLTLTLFEDREMIEERLKTYA

HLFDDKVMKQLKRRRYTGWGRLSRKLINGIRDKQSGKTIL

DFLKSDGFANRNFMQLIHDDSLTFKEDIQKAQVSGQGDSL

EIEHIANLAGSPAIKKGILQTVKVVDELVKVMGRHKPENI

VIEMARENQTTQKGQKNSRERMKRIEEGIKELGSQILKEH

PVENTQLQNEKLYLYYLQNGRDMYVDQELDINRLSDYDVD

HIVPQSFLKDDSIDNKVLTRSDKNRGKSDNVPSEEVVKKM

KNYWRQLLNAKLITQRKFDNLTKAERGGLSELDKAGFIKR

QLVETRQITKHVAQILDSRMNTKYDENDKLIREVKVITLK

SKLVSDFRKDFQFYKVREINNYHHAHDAYLNAVVGTALIK

KYPKLESEFVYGDYKVYDVRKMIAKSEQEIGKATAKYFFY

SNIMNFFKTEITLANGEIRKRPLIETNGETGGSGGSSSET

GPVAVDPTLRRRIEPHEFEVFFDPRELRKETCLLYEINWG

GRHSIWRHTSQNTNKHVEVNFIEKFTTERYFCPNTRCSIT

WFLSWSPCGECSRAITEFLSRYPHVTLFIYIARLYHHADP

RNRQGLRDLISSGVTIQIMTEQESGYCWRNFVNYSPSNEA

HWPRYPHLWVRLYVLELYCIILGLPPCLNILRRKQPQLTF

FTIALQSCHYQRLPPHILWATGLKGSSGSETPGTSESATP

ESSGGEIVWDKGRDFATVRKVLSMPQVNIVKKTEVQTGGF

SKESILPKRNSDKLIARKKDWDPKKYGGFDSPTVAYSVLV

VAKVEKGKSKKLKSVKELLGITIMERSSFEKNPIDFLEAK

GYKEVKKDLIIKLPKYSLFELENGRKRMLASAGELQKGNE

-continued

LALPSKYVNFLYLASHYEKLKGSPEDNEQKQLFVEQHKHY

LDEIIEQISEFSKRVILADANLDKVLSAYNKHRDKPIREQ

AENIIHLFTLTNLGAPAAFKYFDTTIDRKRYTSTKEVLDA

TLIHQSITGLYETRIDLSQLGGDSGGSGGSGGSTNLSDII

EKETGKQLVIQESILMLPEEVEEVIGNKPESDILVHTAYD

ESTDENVMLLTSDAPEYKPWALVIQDSNGENKIKMLSGGS

GGSGGSTNLSDIIEKETGKQLVIQESILMLPEEVEEVIGN

KPESDILVHTAYDESTDENVMLLTSDAPEYKPWALVIQDS

NGENKIKMLPKKKRKVEGADKRTADGSEFESPKKKRKV* pHRB-048_GGS-rAP: rAPOBEC1-XTEN-
ins-site6-G1247-D10A-UGIx2
ATGGACAAGAAGTACAGCATCGGCCTGGCCATCGGCACCA

ACTCTGTGGGCTGGGCCGTGATCACCGACGAGTACAAGGT

GCCCAGCAAGAAATTCAAGGTGCTGGGCAACACCGACCGG

CACAGCATCAAGAAGAACCTGATCGGAGCCCTGCTGTTCG

ACAGCGGCGAAACAGCCGAGGCCACCCGGCTGAAGAGAAC

CGCCAGAAGAAGATACACCAGACGGAAGAACCGGATCTGC

TATCTGCAAGAGATCTTCAGCAACGAGATGGCCAAGGTGG

ACGACAGCTTCTTCCACAGACTGGAAGAGTCCTTCCTGGT

GGAAGAGGATAAGAAGCACGAGCGGCACCCCATCTTCGGC

AACATCGTGGACGAGGTGGCCTACCACGAGAAGTACCCCA

CCATCTACCACCTGAGAAAGAAACTGGTGGACAGCACCGA

CAAGGCCGACCTGCGGCTGATCTATCTGGCCCTGGCCCAC

ATGATCAAGTTCCGGGGCCACTTCCTGATCGAGGGCGACC

TGAACCCCGACAACAGCGACGTGGACAAGCTGTTCATCCA

GCTGGTGCAGACCTACAACCAGCTGTTCGAGGAAAACCCC

ATCAACGCCAGCGGCGTGGACGCCAAGGCCATCCTGTCTG

CCAGACTGAGCAAGAGCAGACGGCTGGAAAATCTGATCGC

CCAGCTGCCCGGCGAGAAGAAGAATGGCCTGTTCGGAAAC

CTGATTGCCCTGAGCCTGGGCCTGACCCCCAACTTCAAGA

GCAACTTCGACCTGGCCGAGGATGCCAAACTGCAGCTGAG

CAAGGACACCTACGACGACGACCTGGACAACCTGCTGGCC

CAGATCGGCGACCAGTACGCCGACCTGTTTCTGGCCGCCA

AGAACCTGTCCGACGCCATCCTGCTGAGCGACATCCTGAG

AGTGAACACCGAGATCACCAAGGCCCCCCTGAGCGCCTCT

ATGATCAAGAGATACGACGAGCACCACCAGGACCTGACCC

TGCTGAAAGCTCTCGTGCGGCAGCAGCTGCCTGAGAAGTA

CAAAGAGATTTTCTTCGACCAGAGCAAGAACGGCTACGCC

GGCTACATTGACGGCGGAGCCAGCCAGGAAGAGTTCTACA

AGTTCATCAAGCCCATCCTGGAAAAGATGGACGGCACCGA

GGAACTGCTCGTGAAGCTGAACAGAGAGGACCTGCTGCGG

-continued

AAGCAGCGGACCTTCGACAACGGCAGCATCCCCCACCAGA

TCCACCTGGGAGAGCTGCACGCCATTCTGCGGCGGCAGGA

AGATTTTTACCCATTCCTGAAGGACAACCGGGAAAAGATC

GAGAAGATCCTGACCTTCCGCATCCCCTACTACGTGGGCC

CTCTGGCCAGGGGAAACAGCAGATTCGCCTGGATGACCAG

AAAGAGCGAGGAAACCATCACCCCCTGGAACTTCGAGGAA

GTGGTGGACAAGGGCGCTTCCGCCCAGAGCTTCATCGAGC

GGATGACCAACTTCGATAAGAACCTGCCCAACGAGAAGGT

GCTGCCCAAGCACAGCCTGCTGTACGAGTACTTCACCGTG

TATAACGAGCTGACCAAAGTGAAATACGTGACCGAGGGAA

TGAGAAAGCCCGCCTTCCTGAGCGGCGAGCAGAAAAAGGC

CATCGTGGACCTGCTGTTCAAGACCAACCGGAAAGTGACC

GTGAAGCAGCTGAAAGAGGACTACTTCAAGAAAATCGAGT

GCTTCGACTCCGTGGAAATCTCCGGCGTGGAAGATCGGTT

CAACGCCTCCCTGGGCACATACCACGATCTGCTGAAAATT

ATCAAGGACAAGGACTTCCTGGACAATGAGGAAAACGAGG

ACATTCTGGAAGATATCGTGCTGACCCTGACACTGTTTGA

GGACAGAGAGATGATCGAGGAACGGCTGAAAACCTATGCC

CACCTGTTCGACGACAAAGTGATGAAGCAGCTGAAGCGGC

GGAGATACACCGGCTGGGGCAGGCTGAGCCGGAAGCTGAT

CAACGGCATCCGGGACAAGCAGTCCGGCAAGACAATCCTG

GATTTCCTGAAGTCCGACGGCTTCGCCAACAGAAACTTCA

TGCAGCTGATCCACGACGACAGCCTGACCTTTAAAGAGGA

CATCCAGAAAGCCCAGGTGTCCGGCCAGGGCGATAGCCTG

CACGAGCACATTGCCAATCTGGCCGGCAGCCCCGCCATTA

AGAAGGGCATCCTGCAGACAGTGAAGGTGGTGGACGAGCT

CGTGAAAGTGATGGGCCGGCACAAGCCCGAGAACATCGTG

ATCGAAATGGCCAGAGAGAACCAGACCACCCAGAAGGGAC

AGAAGAACAGCCGCGAGAGAATGAAGCGGATCGAAGAGGG

CATCAAAGAGCTGGGCAGCCAGATCCTGAAAGAACACCCC

GTGGAAAACACCCAGCTGCAGAACGAGAAGCTGTACCTGT

ACTACCTGCAGAATGGGCGGGATATGTACGTGGACCAGGA

ACTGGACATCAACCGGCTGTCCGACTACGATGTGGACCAT

ATCGTGCCTCAGAGCTTTCTGAAGGACGACTCCATCGACA

ACAAGGTGCTGACCAGAAGCGACAAGAACCGGGGCAAGAG

CGACAACGTGCCCTCCGAAGAGGTCGTGAAGAAGATGAAG

AACTACTGGCGGCAGCTGCTGAACGCCAAGCTGATTACCC

AGAGAAAGTTCGACAATCTGACCAAGGCCGAGAGAGGCGG

CCTGAGCGAACTGGATAAGGCCGGCTTCATCAAGAGACAG

CTGGTGGAAACCCGGCAGATCACAAAGCACGTGGCACAGA

TCCTGGACTCCCGGATGAACACTAAGTACGACGAGAATGA

-continued

CAAGCTGATCCGGGAAGTGAAAGTGATCACCCTGAAGTCC

AAGCTGGTGTCCGATTTCCGGAAGGATTTCCAGTTTTACA

AAGTGCGCGAGATCAACAACTACCACCACGCCCACGACGC

CTACCTGAACGCCGTCGTGGGAACCGCCCTGATCAAAAAG

TACCCTAAGCTGGAAAGCGAGTTCGTGTACGGCGACTACA

AGGTGTACGACGTGCGGAAGATGATCGCCAAGAGCGAGCA

GGAAATCGGCAAGGCTACCGCCAAGTACTTCTTCTACAGC

AACATCATGAACTTTTTCAAGACCGAGATTACCCTGGCCA

ACGGCGAGATCCGGAAGCGGCCTCTGATCGAGACAAACGG

CGAAACCGGGGAGATCGTGTGGGATAAGGGCCGGGATTTT

GCCACCGTGCGGAAAGTGCTGAGCATGCCCCAAGTGAATA

TCGTGAAAAAGACCGAGGTGCAGACAGGCGGCTTCAGCAA

AGAGTCTATCCTGCCCAAGAGGAACAGCGATAAGCTGATC

GCCAGAAAGAAGGACTGGGACCCTAAGAAGTACGGCGGCT

TCGACAGCCCCACCGTGGCCTATTCTGTGCTGGTGGTGGC

CAAAGTGGAAAAGGGCAAGTCCAAGAAACTGAAGAGTGTG

AAAGAGCTGCTGGGGATCACCATCATGGAAAGAAGCAGCT

TCGAGAAGAATCCCATCGACTTTCTGGAAGCCAAGGGCTA

CAAAGAAGTGAAAAAGGACCTGATCATCAAGCTGCCTAAG

TACTCCCTGTTCGAGCTGGAAAACGGCCGGAAGAGAATGC

TGGCCTCTGCCGGCGAACTGCAGAAGGGAAACGAACTGGC

CCTGCCCTCCAAATATGTGAACTTCCTGTACCTGGCCAGC

CACTATGAGAAGCTGAAGGGCGGAGGCTCTGGAGGAAGCA

GCTCTGAGACAGGACCTGTGGCCGTGGATCCCACACTGCG

GAGAAGAATTGAGCCCCACGAGTTCGAGGTGTTCTTCGAC

CCCAGAGAGCTGCGGAAAGAGACATGCCTGCTGTACGAGA

TCAACTGGGGCGGCAGACACTCTATCTGGCGGCACACAAG

CCAGAACACCAACAAGCACGTGGAAGTGAACTTTATCGAG

AAGTTTACGACCGAGCGGTACTTCTGCCCCAACACCAGAT

GCAGCATCACCTGGTTTCTGAGCTGGTCCCCTTGCGGCGA

GTGCAGCAGAGCCATCACCGAGTTTCTGTCCAGATATCCC

CACGTGACCCTGTTCATCTATATCGCCCGGCTGTACCACC

ACGCCGATCCTAGAAATAGACAGGGCCTGCGCGACCTGAT

CAGCAGCGGAGTGACAATCCAGATCATGACCGAGCAAGAG

AGCGGCTACTGCTGGCGGAACTTCGTGAACTACAGCCCCA

GCAACGAAGCCCACTGGCCTAGATATCCTCACCTGTGGGT

CCGACTGTACGTGCTGGAACTGTACTGCATCATCCTGGGC

CTGCCTCCATGCCTGAACATCCTGAGAAGAAAGCAGCCTC

AGCTGACCTTCTTCACAATCGCCCTGCAGAGCTGCCACTA

CCAGAGACTGCCTCCACACATCCTGTGGGCCACCGGACTT

-continued

AAGGGCTCTTCTGGATCTGAAACACCTGGCACAAGTGAGA

GCGCCACCCCTGAGAGCTCTGGCTCCCCCGAGGATAATGA

GCAGAAACAGCTGTTTGTGGAACAGCACAAGCACTACCTG

GACGAGATCATCGAGCAGATCAGCGAGTTCTCCAAGAGAG

TGATCCTGGCCGACGCTAATCTGGACAAAGTGCTGTCCGC

CTACAACAAGCACCGGGATAAGCCCATCAGAGAGCAGGCC

GAGAATATCATCCACCTGTTTACCCTGACCAATCTGGGAG

CCCCTGCCGCCTTCAAGTACTTTGACACCACCATCGACCG

GAAGAGGTACACCAGCACCAAAGAGGTGCTGGACGCCACC

CTGATCCACCAGAGCATCACCGGCCTGTACGAGACACGGA

TCGACCTGTCTCAGCTGGGAGGTGACTCTGGTGGAAGCGG

AGGATCTGGCGGCAGCACCAATCTGAGCGACATCATCGAG

AAAGAGACAGGCAAGCAGCTGGTCATCCAAGAGTCCATCC

TGATGCTGCCTGAAGAGGTGGAAGAAGTGATCGGCAACAA

GCCCGAGTCCGACATCCTGGTGCACACCGCCTACGATGAG

AGCACCGACGAGAACGTGATGCTGCTGACCTCTGACGCCC

CTGAGTACAAGCCTTGGGCTCTCGTGATCCAGGACAGCAA

CGGCGAGAACAAGATCAAGATGCTGAGCGGCGGCTCTGGT

GGCTCTGGCGGATCTACAAACCTGTCCGATATTATTGAGA

AAGAAACCGGGAAACAGCTCGTGATTCAAGAGTCTATTCT

CATGCTCCCGGAAGAAGTCGAGGAAGTCATTGGAAACAAG

CCTGAGAGCGATATTCTGGTCCATACAGCCTACGACGAGT

CTACCGATGAGAATGTCATGCTCCTCACCAGCGACGCTCC

CGAGTATAAGCCATGGGCACTTGTCATTCAGGACTCCAAT

GGGGAAAACAAAATCAAAATGCTCCCAAAGAAAAAACGCA

AGGTGGAGGGAGCTGATAAGCGCACCGCCGATGGTTCCGA

GTTCGAAAGCCCCAAGAAGAAGAGGAAAGTCTAACCGGTC

ATCATCACCATCACCATTGAGTTTAAACCCGCTGATCAGC

CTCGACTGTGCCTTCTAGTTGCCAGCCATCTGTTGTTTGC

CCCTCCCCCGTGCCTTCCTTGACCCTGGAAGGTGCCACTC

CCACTGTCCTTTCCTAATAAAATGAGGAAATTGCATCGCA

TTGTCTGAGTAGGTGTCATTCTATTCTGGGGGGTGGGGTG

GGGCAGGACAGCAAGGGGGAGGATTGGGAAGACAATAGCA

GGCATGCTGGGGATGCGGTGGGCTCTATGGCTTCTGAGGC

GGAAAGAACCAGCTGGGGCTCGATACCGTCGACCTCTAGC

TAGAGCTTGGCGTAATCATGGTCATAGCTGTTTCCTGTGT

GAAATTGTTATCCGCTCACAATTCCACACAACATACGAGC

CGGAAGCATAAAGTGTAAAGCCTAGGGTGCCTAATGAGTG

AGCTAACTCACATTAATTGCGTTGCGCTCACTGCCCGCTT

TCCAGTCGGGAAACCTGTCGTGCCAGCTGCATTAATGAAT

CGGCCAACGCGCGGGGAGAGGCGGTTTGCGTATTGGGCGC

-continued

TCTTCCGCTTCCTCGCTCACTGACTCGCTGCGCTCGGTCG

TTCGGCTGCGGCGAGCGGTATCAGCTCACTCAAAGGCGGT

AATACGGTTATCCACAGAATCAGGGGATAACGCAGGAAAG

AACATGTGAGCAAAAGGCCAGCAAAAGGCCAGGAACCGTA

AAAAGGCCGCGTTGCTGGCGTTTTTCCATAGGCTCCGCCC

CCCTGACGAGCATCACAAAAATCGACGCTCAAGTCAGAGG

TGGCGAAACCCGACAGGACTATAAAGATACCAGGCGTTTC

CCCCTGGAAGCTCCCTCGTGCGCTCTCCTGTTCCGACCCT

GCCGCTTACCGGATACCTGTCCGCCTTTCTCCCTTCGGGA

AGCGTGGCGCTTTCTCATAGCTCACGCTGTAGGTATCTCA

GTTCGGTGTAGGTCGTTCGCTCCAAGCTGGGCTGTGTGCA

CGAACCCCCCGTTCAGCCCGACCGCTGCGCCTTATCCGGT

AACTATCGTCTTGAGTCCAACCCGGTAAGACACGACTTAT

CGCCACTGGCAGCAGCCACTGGTAACAGGATTAGCAGAGC

GAGGTATGTAGGCGGTGCTACAGAGTTCTTGAAGTGGTGG

CCTAACTACGGCTACACTAGAAGAACAGTATTTGGTATCT

GCGCTCTGCTGAAGCCAGTTACCTTCGGAAAAAGAGTTGG

TAGCTCTTGATCCGGCAAACAAACCACCGCTGGTAGCGGT

GGTTTTTTTGTTTGCAAGCAGCAGATTACGCGCAGAAAAA

AAGGATCTCAAGAAGATCCTTTGATCTTTTCTACGGGGTC

TGACGCTCAGTGGAACGAAAACTCACGTTAAGGGATTTTG

GTCATGAGATTATCAAAAAGGATCTTCACCTAGATCCTTT

TAAATTAAAAATGAAGTTTTAAATCAATCTAAAGTATATA

TGAGTAAACTTGGTCTGACAGTTACCAATGCTTAATCAGT

GAGGCACCTATCTCAGCGATCTGTCTATTTCGTTCATCCA

TAGTTGCCTGACTCCCCGTCGTGTAGATAACTACGATACG

GGAGGGCTTACCATCTGGCCCCAGTGCTGCAATGATACCG

CGAGACCCACGCTCACCGGCTCCAGATTTATCAGCAATAA

ACCAGCCAGCCGGAAGGGCCGAGCGCAGAAGTGGTCCTGC

AACTTTATCCGCCTCCATCCAGTCTATTAATTGTTGCCGG

GAAGCTAGAGTAAGTAGTTCGCCAGTTAATAGTTTGCGCA

ACGTTGTTGCCATTGCTACAGGCATCGTGGTGTCACGCTC

GTCGTTTGGTATGGCTTCATTCAGCTCCGGTTCCCAACGA

TCAAGGCGAGTTACATGATCCCCCATGTTGTGCAAAAAAG

CGGTTAGCTCCTTCGGTCCTCCGATCGTTGTCAGAAGTAA

GTTGGCCGCAGTGTTATCACTCATGGTTATGGCAGCACTG

CATAATTCTCTTACTGTCATGCCATCCGTAAGATGCTTTT

CTGTGACTGGTGAGTACTCAACCAAGTCATTCTGAGAATA

GTGTATGCGGCGACCGAGTTGCTCTTGCCCGGCGTCAATA

CGGGATAATACCGCGCCACATAGCAGAACTTTAAAAGTGC

-continued

```
TCATCATTGGAAAACGTTCTTCGGGGCGAAAACTCTCAAG

GATCTTACCGCTGTTGAGATCCAGTTCGATGTAACCCACT

CGTGCACCCAACTGATCTTCAGCATCTTTTACTTTCACCA

GCGTTTCTGGGTGAGCAAAAACAGGAAGGCAAAATGCCGC

AAAAAAGGGAATAAGGGCGACACGGAAATGTTGAATACTC

ATACTCTTCCTTTTTCAATATTATTGAAGCATTTATCAGG

GTTATTGTCTCATGAGCGGATACATATTTGAATGTATTTA

GAAAAATAAACAAATAGGGGTTCCGCGCACATTTCCCCGA

AAAGTGCCACCTGACGTCGACGGATCGGGAGATCGATCTC

CCGATCCCCTAGGGTCGACTCTCAGTACAATCTGCTCTGA

TGCCGCATAGTTAAGCCAGTATCTGCTCCCTGCTTGTGTG

TTGGAGGTCGCTGAGTAGTGCGCGAGCAAAATTTAAGCTA

CAACAAGGCAAGGCTTGACCGACAATTGCATGAAGAATCT

GCTTAGGGTTAGGCGTTTTGCGCTGCTTCGCGATGTACGG

GCCAGATATACGCGTTGACATTGATTATTGACTAGTTATT

AATAGTAATCAATTACGGGGTCATTAGTTCATAGCCCATA

TATGGAGTTCCGCGTTACATAACTTACGGTAAATGGCCCG

CCTGGCTGACCGCCCAACGACCCCCGCCCATTGACGTCAA

TAATGACGTATGTTCCCATAGTAACGCCAATAGGGACTTT

CCATTGACGTCAATGGGTGGAGTATTTACGGTAAACTGCC

CACTTGGCAGTACATCAAGTGTATCATATGCCAAGTACGC

CCCCTATTGACGTCAATGACGGTAAATGGCCCGCCTGGCA

TTATGCCCAGTACATGACCTTATGGGACTTTCCTACTTGG

CAGTACATCTACGTATTAGTCATCGCTATTACCATGGTGA

TGCGGTTTTGGCAGTACATCAATGGGCGTGGATAGCGGTT

TGACTCACGGGGATTTCCAAGTCTCCACCCCATTGACGTC

AATGGGAGTTTGTTTTGGCACCAAAATCAACGGGACTTTC

CAAAATGTCGTAACAACTCCGCCCCATTGACGCAAATGGG

CGGTAGGCGTGTACGGTGGGAGGTCTATATAAGCAGAGCT

GGTTTAGTGAACCGTCAGATCCGCTAGAGATCCGCGGCCG

CTAATACGACTCACTATAGGGAGAGCCGCCACC pHRB-048_GGS-rAP: rAPOBEC1-XTEN-
ins-site6-G1247-D10 A-UGIx2
MDKKYSIGLAIGTNSVGWAVITDEYKVPSKKFKVLGNTDRHS

IKKNLIGALLFDSGETAEATRLKRTARRRYTRRKNRICYLQ

EIFSNEMAKVDDSFFHRLEESFLVEEDKKHERHPIFGNIV

DEVAYHEKYPTIYHLRKKLVDSTDKADLRLIYLALAHMIK

FRGHFLIEGDLNPDNSDVDKLFIQLVQTYNQLFEENPINA

SGVDAKAILSARLSKSRRLENLIAQLPGEKKNGLFGNLIA

LSLGLTPNFKSNFDLAEDAKLQLSKDTYDDDLDNLLAQIG

DQYADLFLAAKNLSDAILLSDILRVNTEITKAPLSASMIK

RYDEHHQDLTLLKALVRQQLPEKYKEIFFDQSKNGYAGYI
```

-continued

```
DGGASQEEFYKFIKPILEKMDGTEELLVKLNREDLLRKQR

TFDNGSIPHQIHLGELHAILRRQEDFYPFLKDNREKIEKI

LTFRIPYYVGPLARGNSRFAWMTRKSEETITPWNFEEVVD

KGASAQSFIERMTNFDKNLPNEKVLPKHSLLYEYFTVYNE

LTKVKYVTEGMRKPAFLSGEQKKAIVDLLFKTNRKVTVKQ

LKEDYFKKIECFDSVETSGVEDRFNASLGTYHDLLKIIKD

KDFLDNEENEDILEDIVLTLTLFEDREMIEERLKTYAHLF

DDKVMKQLKRRRYTGWGRLSRKLINGIRDKQSGKTILDFL

KSDGFANRNFMQLIHDDSLTFKEDIQKAQVSGQGDSLHEH

IANLAGSPAIKKGILQTVKVVDELVKVMGRHKPENIVIEM

ARENQTTQKGQKNSRERMKRIEEGIKELGSQILKEHPVEN

TQLQNEKLYLYYLQNGRDMYVDQELDINRLSDYDVDHIVP

QSFLKDDSIDNKVLTRSDKNRGKSDNVPSEEVVKKMKNYW

RQLLNAKLITQRKFDNLTKAERGGLSELDKAGFIKRQLVE

TRQITKHVAQILDSRMNTKYDENDKLIREVKVITLKSKLV

SDFRKDFQFYKVREINNYHHAHDAYLNAVVGTALIKKYPK

LESEFVYGDYKVYDVRKMIAKSEQEIGKATAKYFFYSNIM

NFFKTEITLANGEIRKRPLIETNGETGEIVVVDKGRDFAT

VRKVLSMPQVNIVKKTEVQTGGFSKESILPKRNSDKLIAR

KKDWDPKKYGGFDSPTVAYSVLVVAKVEKGKSKKLKSVKE

LLGITIMERSSFEKNPIDFLEAKGYKEVKKDLIIKLPKYS

LFELENGRKRMLASAGELQKGNELALPSKYVNFLYLASHY

EKLKGGGSGGGSSETGPVAVDPTLRRRIEPHEFEVFFDPR

ELRKETCLLYEINWGGRHSIWRHTSQNTNKHVEVNFIEKF

TTERYFCPNTRCSITWFLSWSPCGECSRAITEFLSRYPHV

TLFIYIARLYHHADPRNRQGLRDLISSGVTIQIMTEQESG

YCWRNFVNYSPSNEAHWPRYPHLWVRLYVLELYCIILGLP

PCLNILRRKQPQLTFFTIALQSCHYQRLPPHILWATGLKG

SSGSETPGTSESATPESSGSPEDNEQKQLFVEQHKHYLDE

IIEQISEFSKRVILADANLDKVLSAYNKHRDKPIREQAEN

IITILFTLINLGAPAAFKYFDTTIDRKRYTSTKEVLDATL

IHQSITGLYETRIDLSQLGGDSGGSGGSGGSTNLSDIIEK

ETGKQLVIQESILMLPEEVEEVIGNKPESDILVHTAYDES

TDENVMLLTSDAPEYKPWALVIQDSNGENKIKMLSGGSGG

SGGSTNLSDIIEKETGKQLVIQESILMLPEEVEEVIGNKP

ESDILVHTAYDESTDENVMLLTSDAPEYKPWALVIQDSNG

ENKIKMLPKKKRKVEGADKRTADGSEFESPKKKRKV*
```

Example 5: ABE Internal Fusion Base Editors

To assess the base editing in cells, HEK293T cells were co-transfected with 100 ng of a sgRNA-encoding plasmid and a base editor encoding plasmid using Lipofectamine® 2000 (Life Technologies) transfection reagent. After 4 days, genomic DNA was isolated, and the targeted genomic region was amplified by PCR. Sequencing adaptors were added to generate a library of PCR products. The prepared PCR library containing the base-edited region was sequenced on an Illumina MiSeq® next generation sequencing instrument.

Figure 20A:
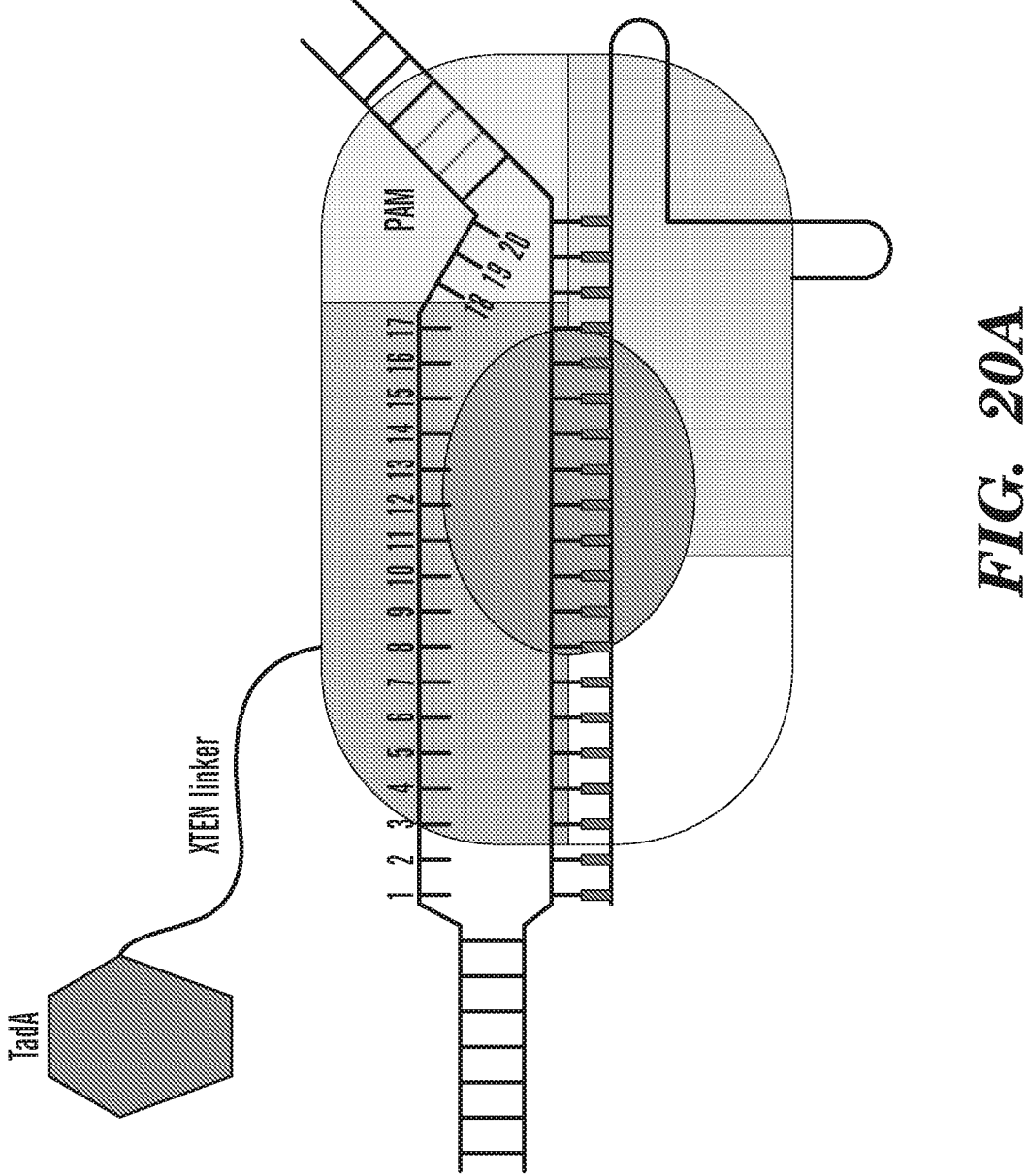
FIGS. 20A-Q depict base editing activity of the editors examined.
Figure 20B:
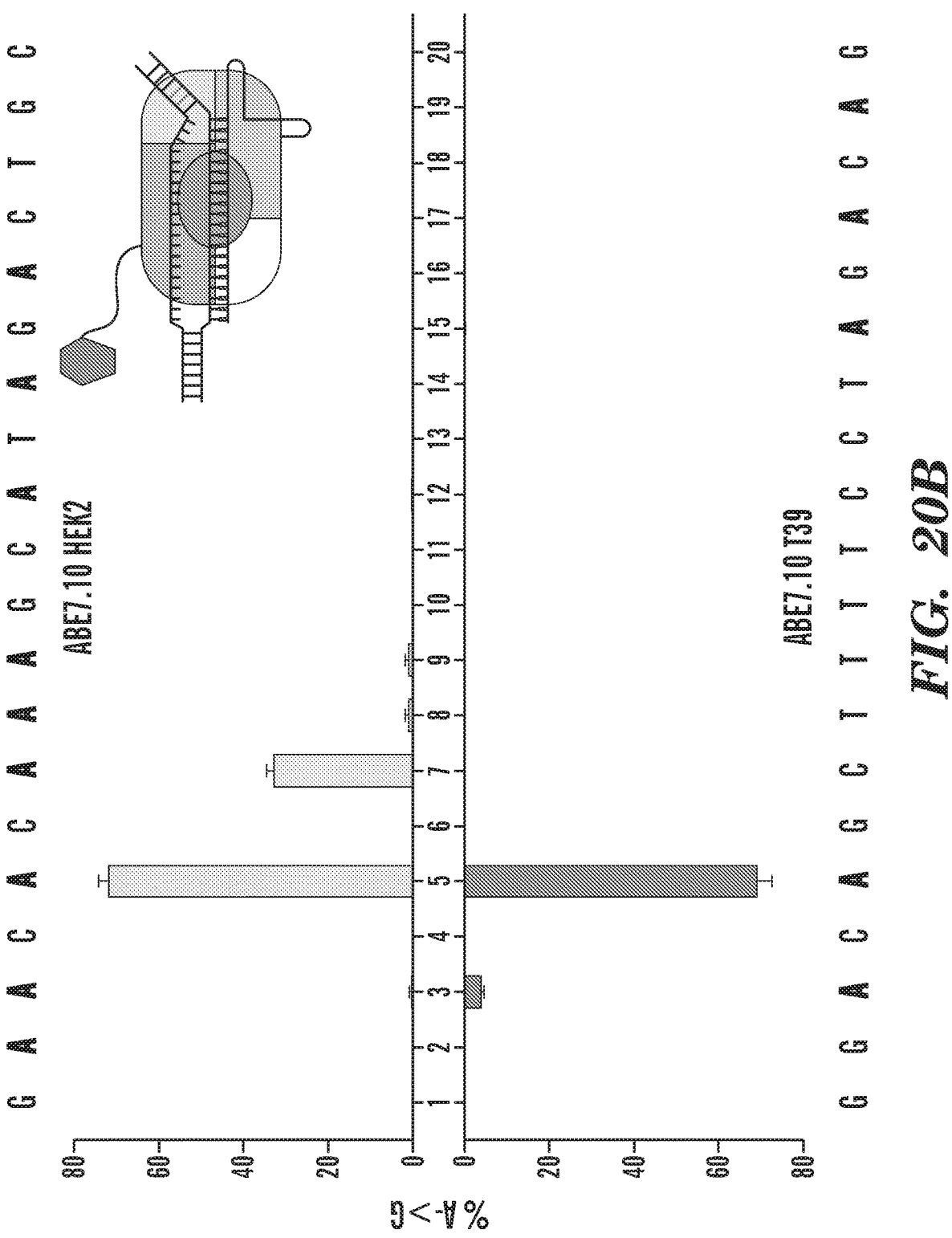
Figure 20C:
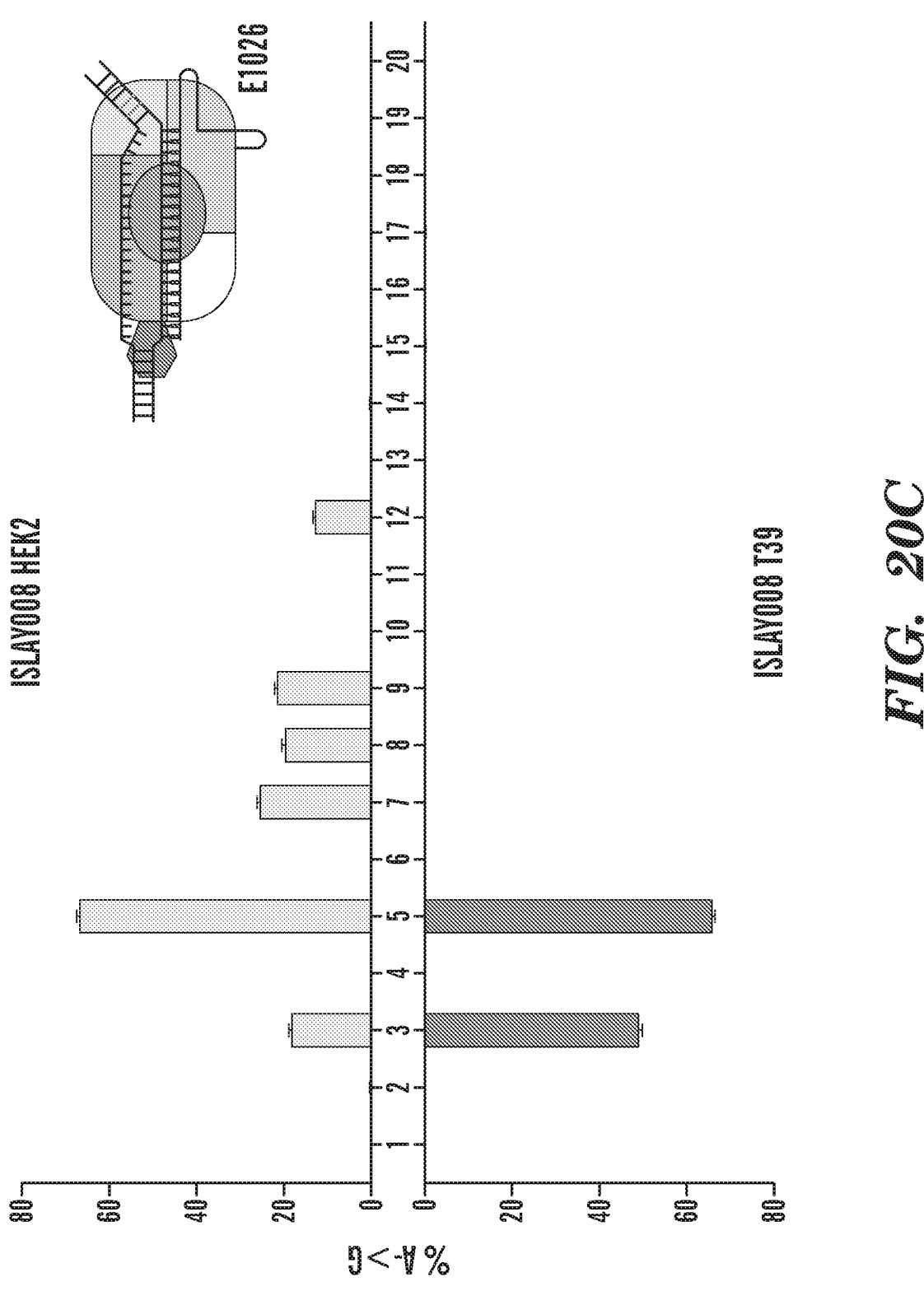
FIG. 20C, editing activity of ISLAY008.
Figure 20D:
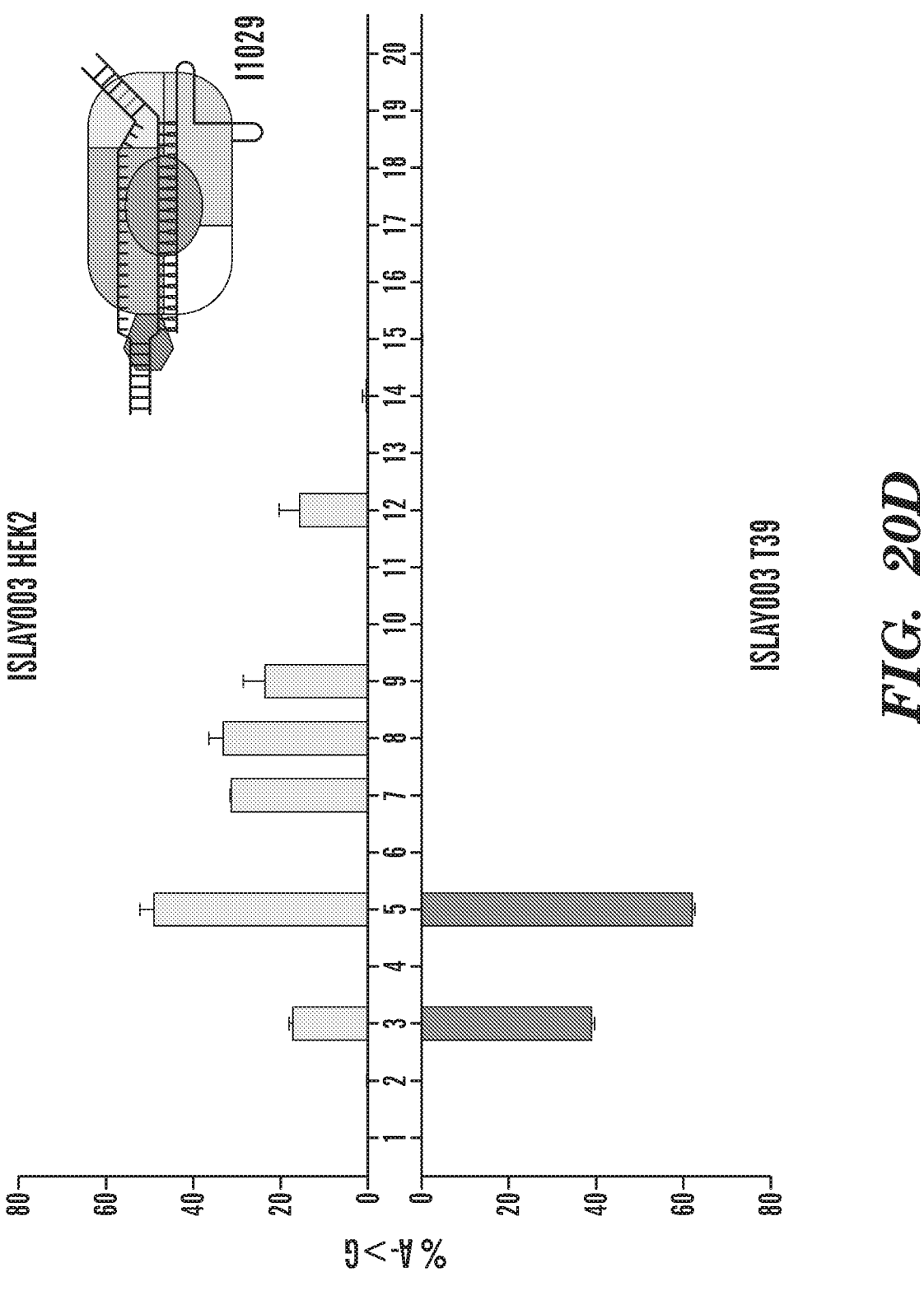
FIG. 20D, editing activity of ISLAY003.
Figure 20E:
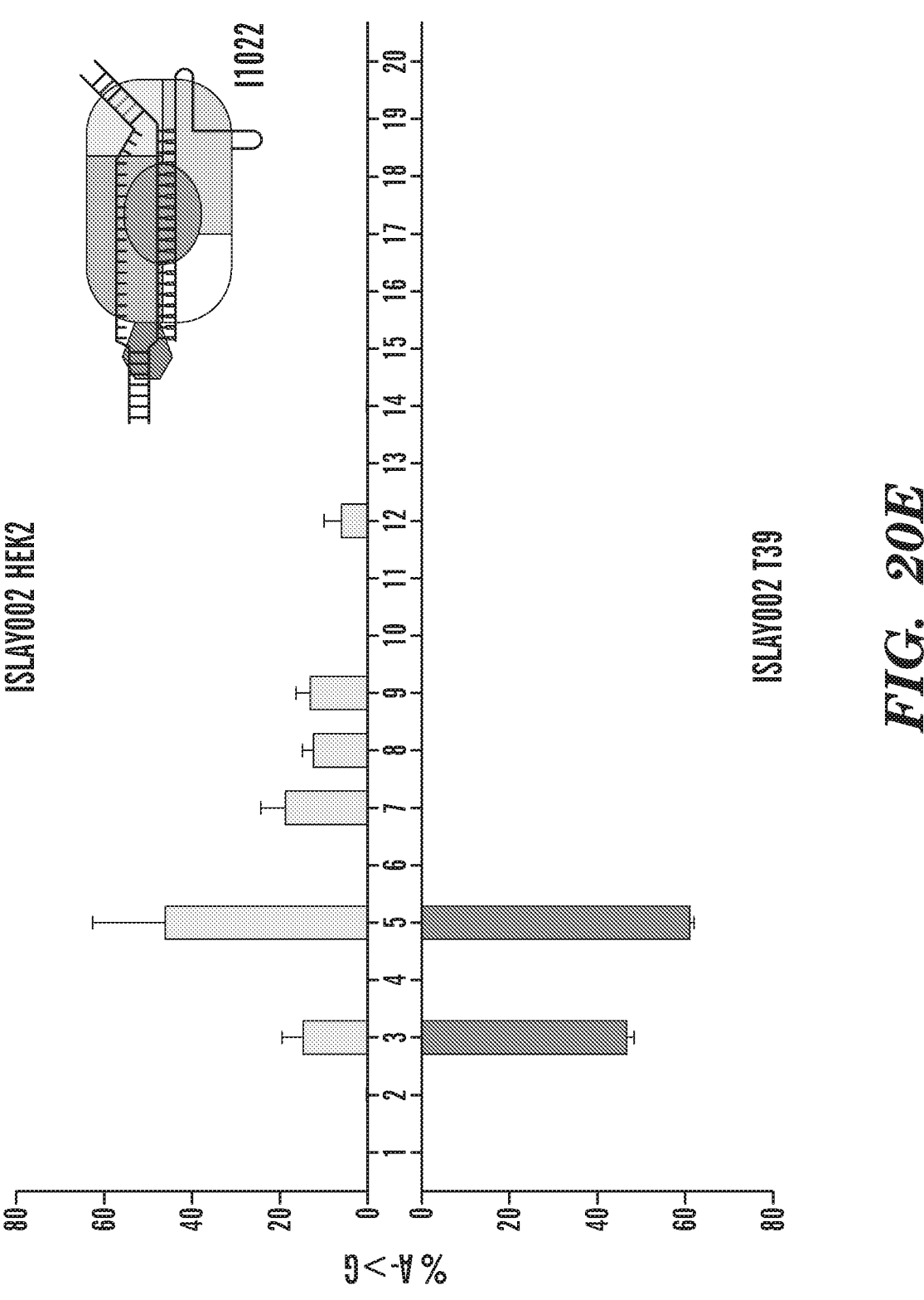
FIG. 20E, editing activity of ISLAY002.
Figure 20F:
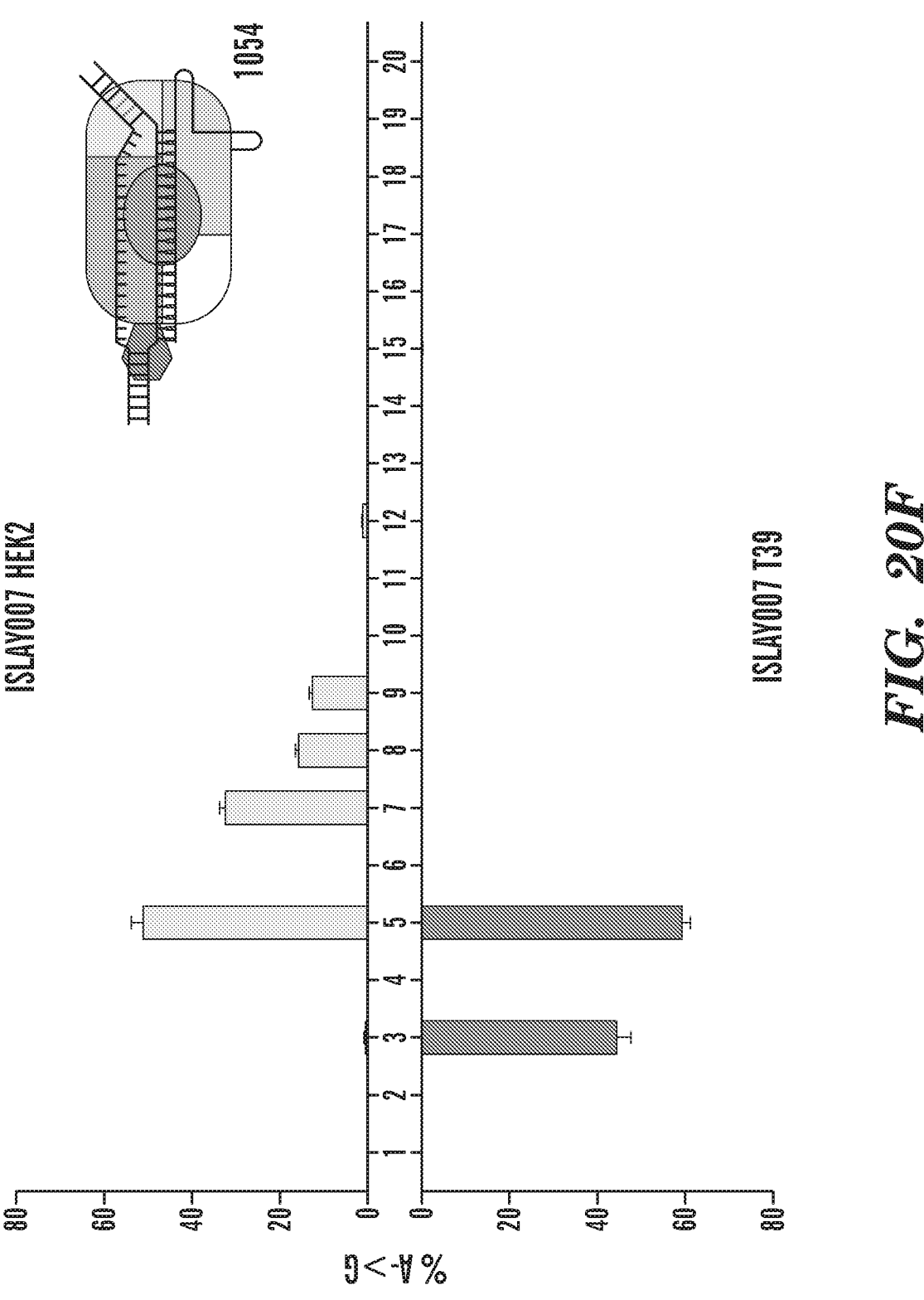
FIG. 20F, editing activity of ISLAY007.
Figure 20G:
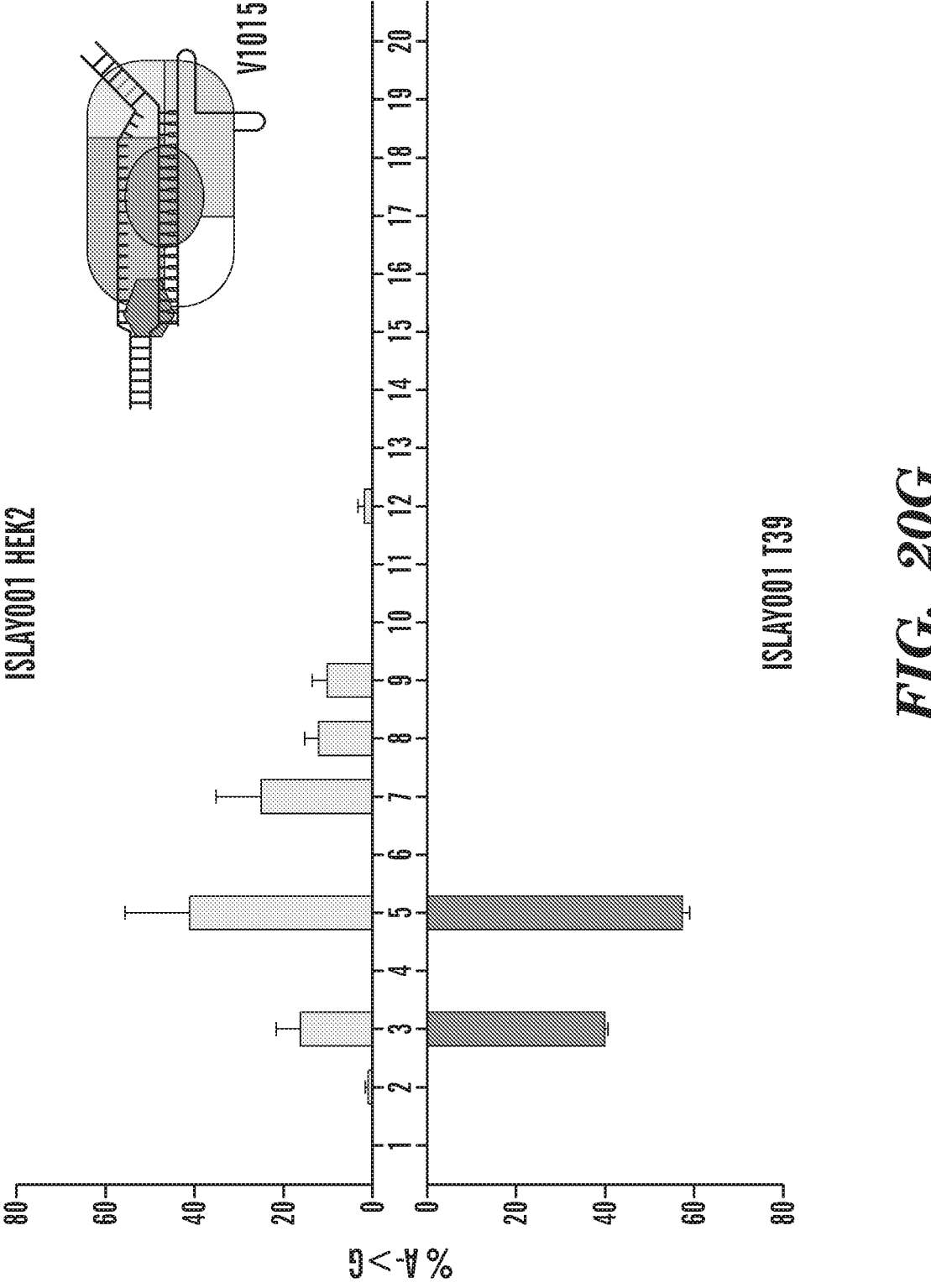
FIG. 20G, editing activity of ISLAY001.
Figure 20H:
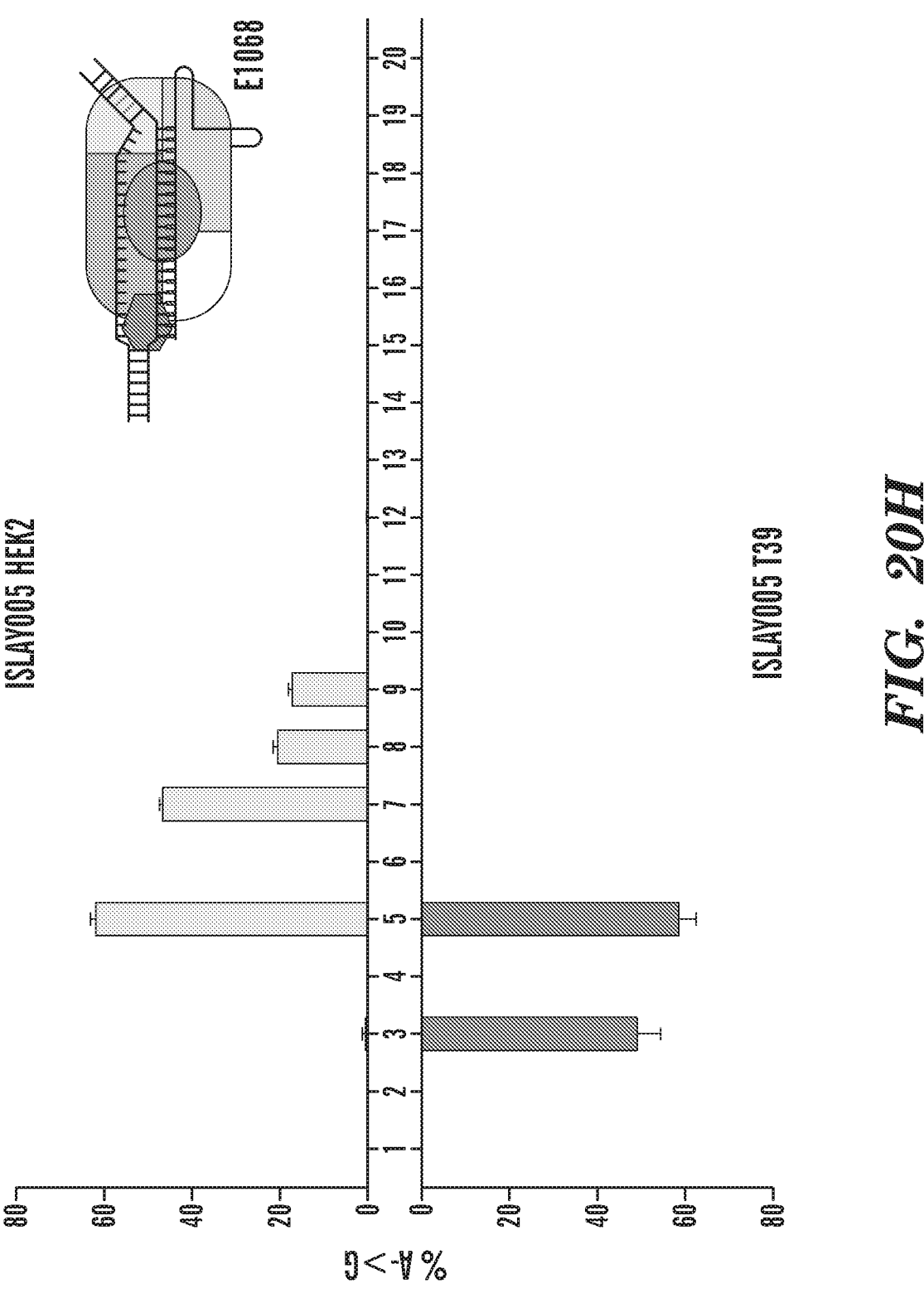
FIG. 20H, editing activity of ISLAY005.
Figure 20I:
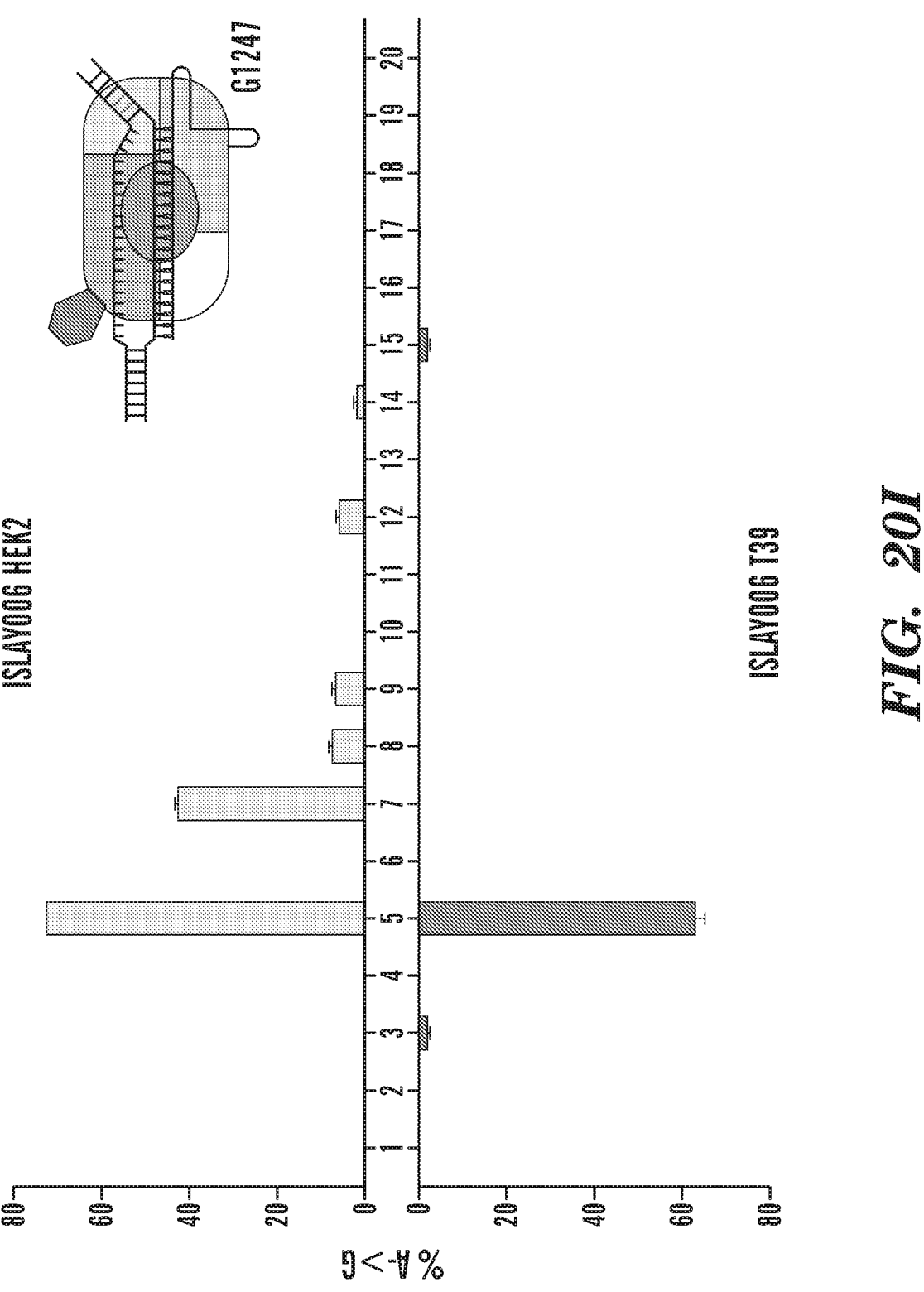
FIG. 20I, editing activity of ISLAY006.
Figure 20J:
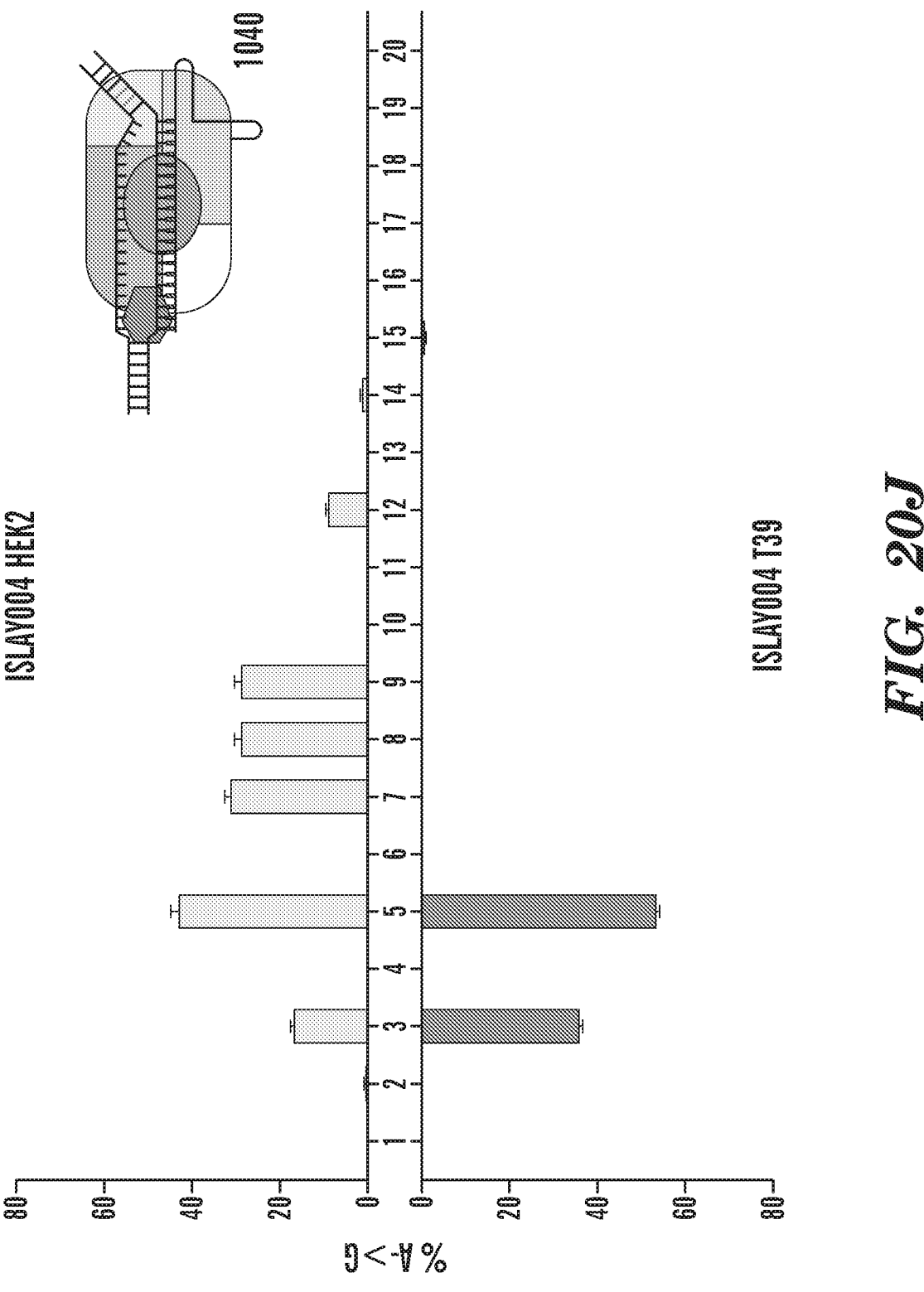
FIG. 20J, editing activity of ISLAY004.
Figure 20K:
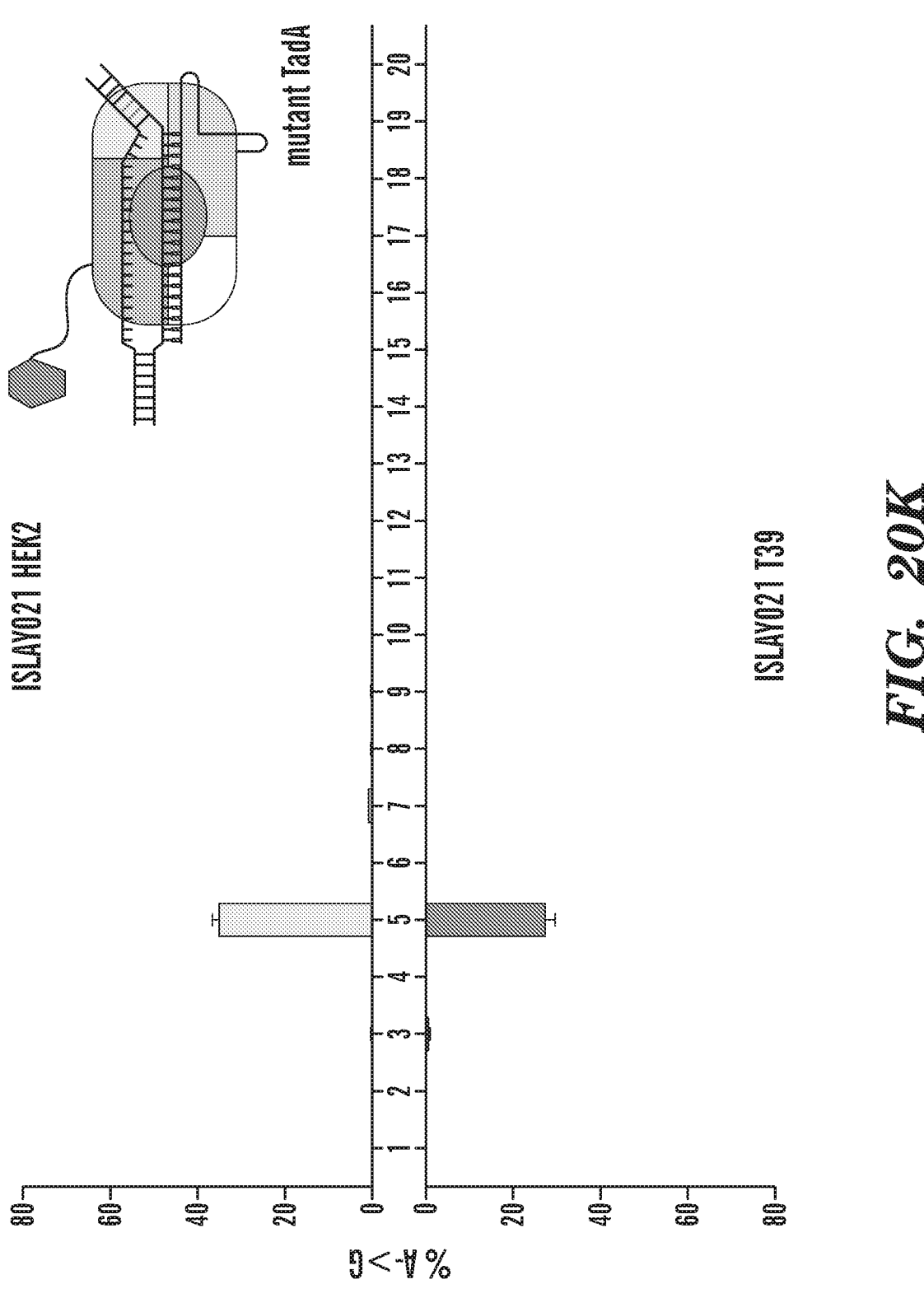
FIG. 20K, editing activity of ISLAY021.
Figure 20L:
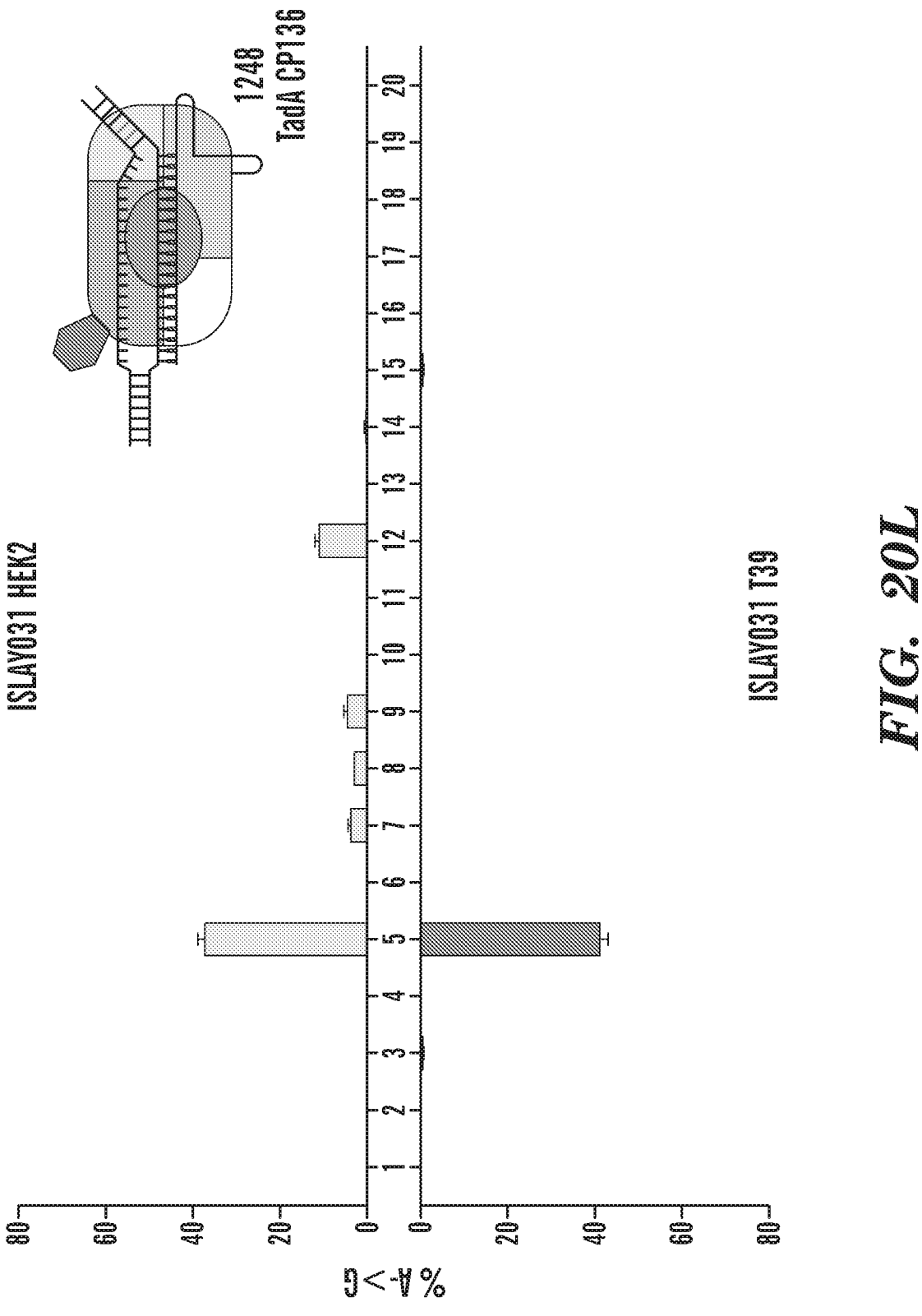
FIG. 20L, editing activity of ISLAY031.
Figure 20M:
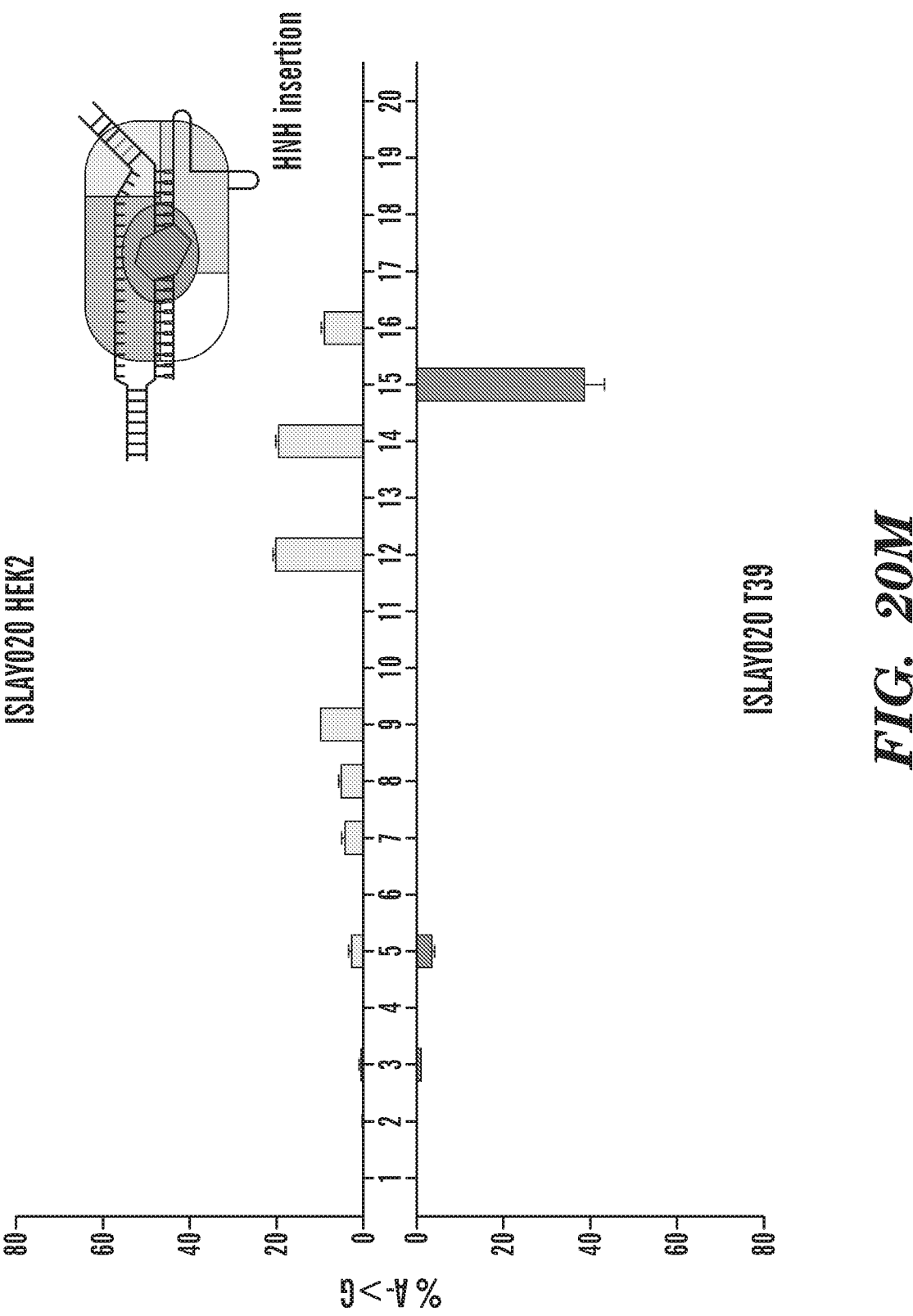
FIG. 20M, editing activity of ISLAY020.
Figure 20N:
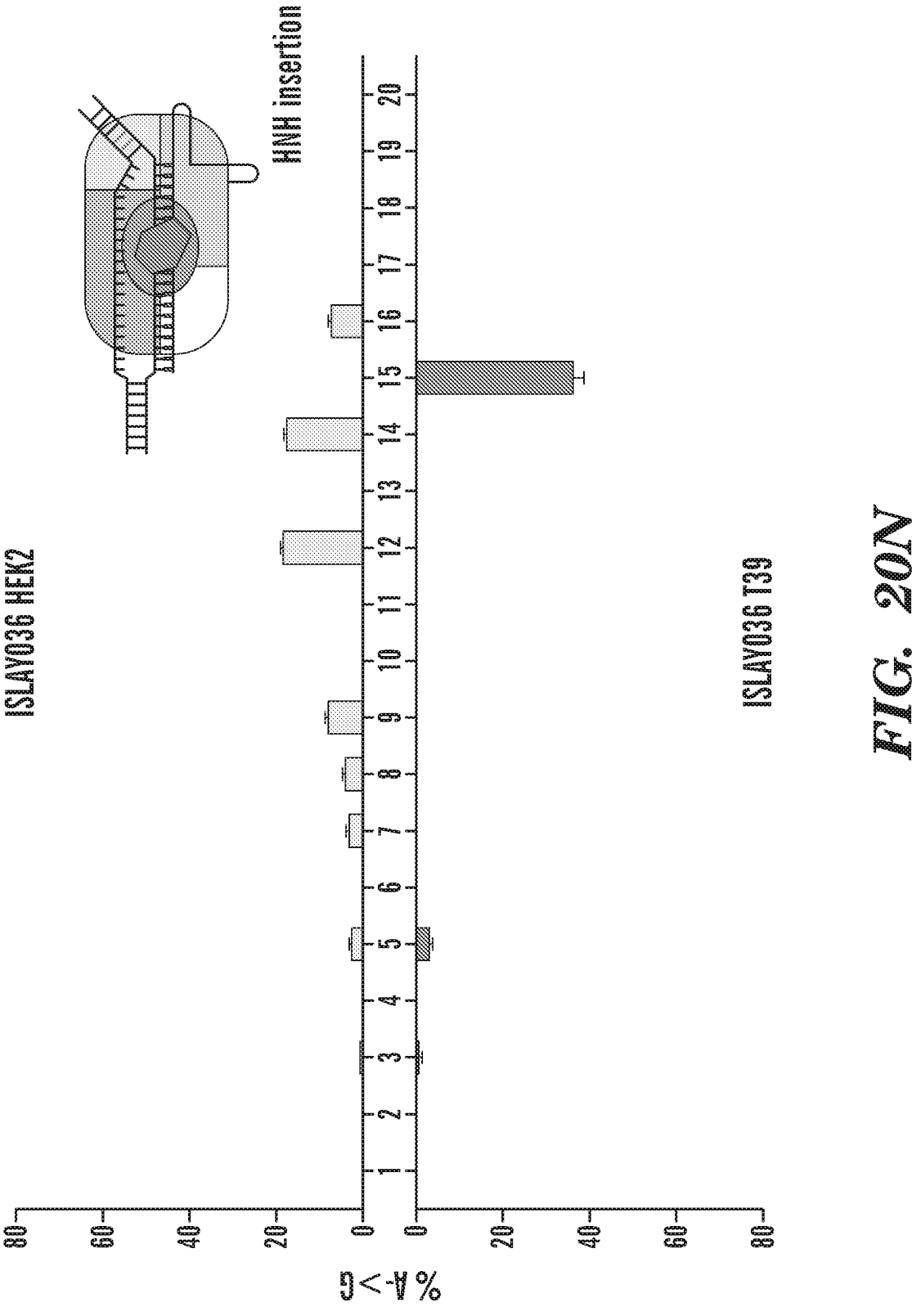
FIG. 20N, editing activity of ISLAY036.
Figure 200:
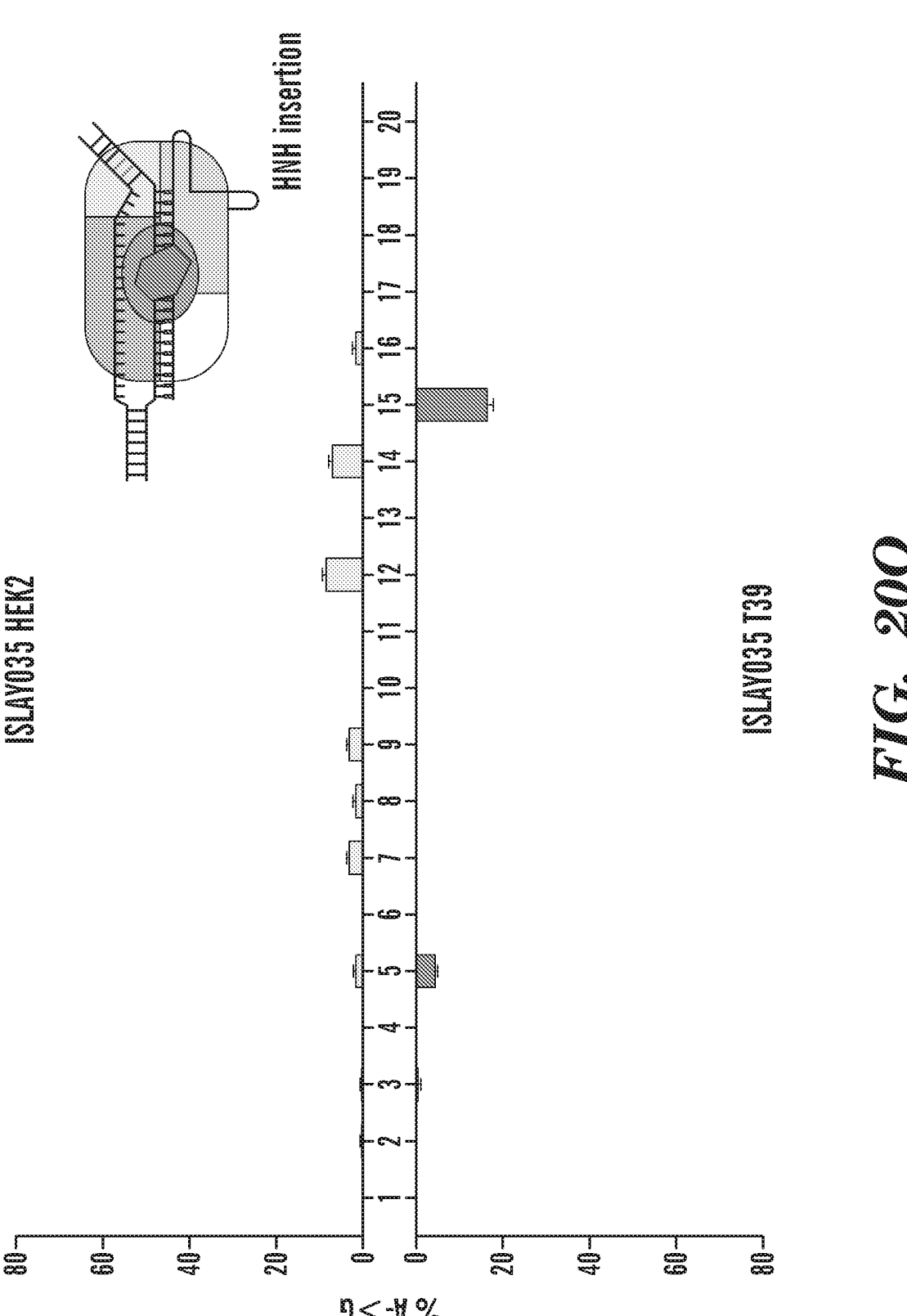
Figure 20P:
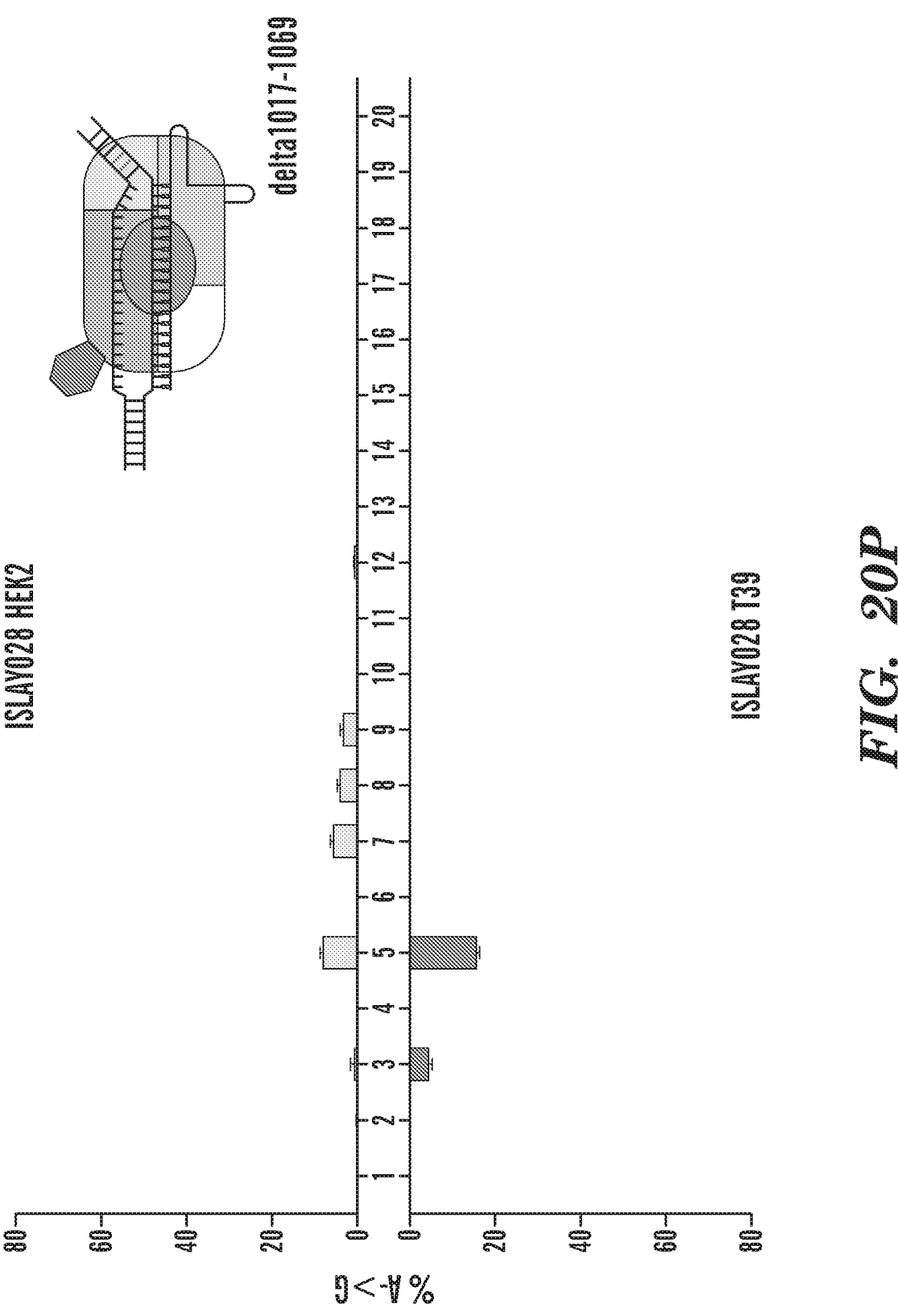
FIG. 20P, editing activity of ISLAY028.
Figure 20Q:
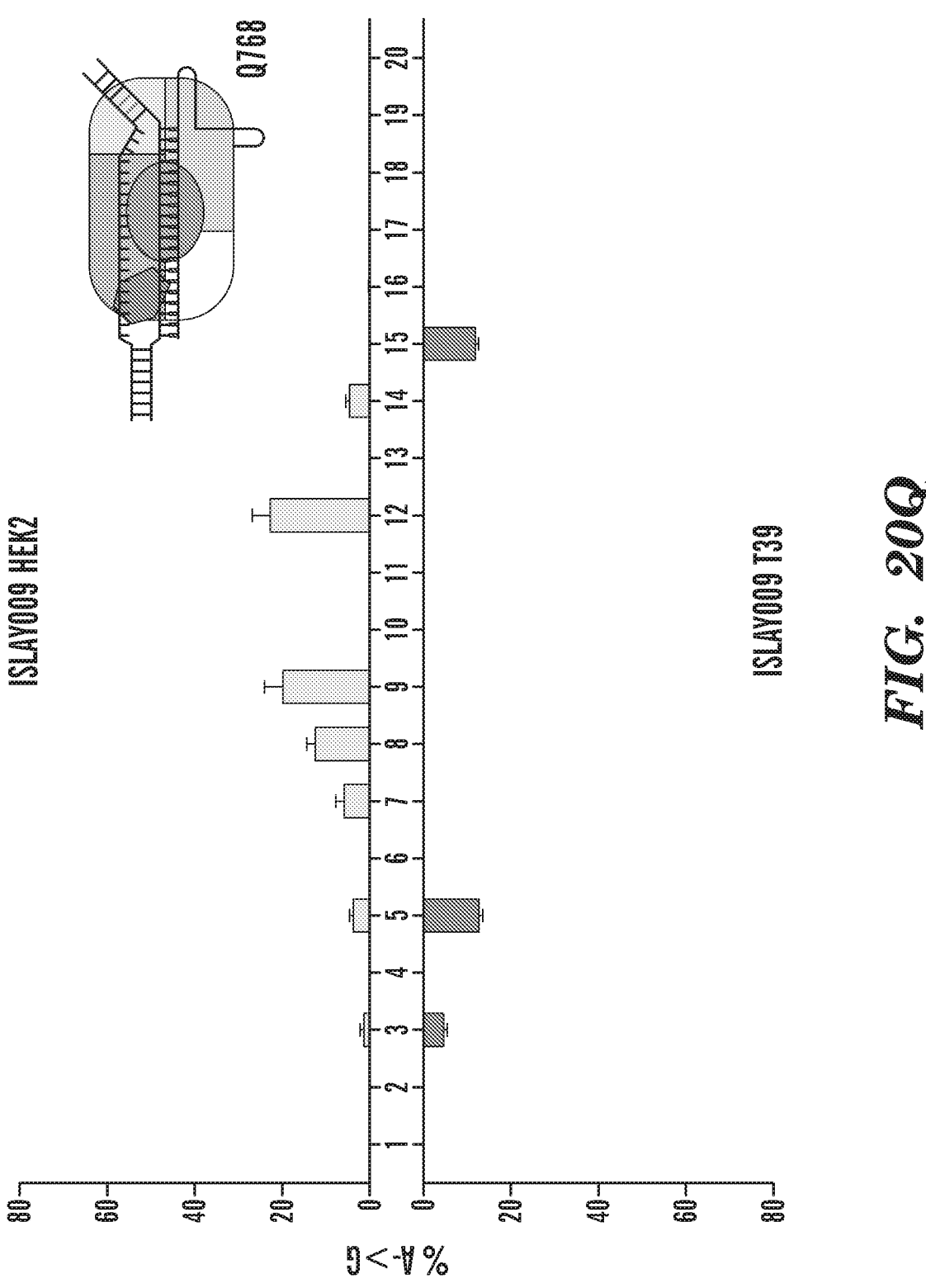
Figure 21A:
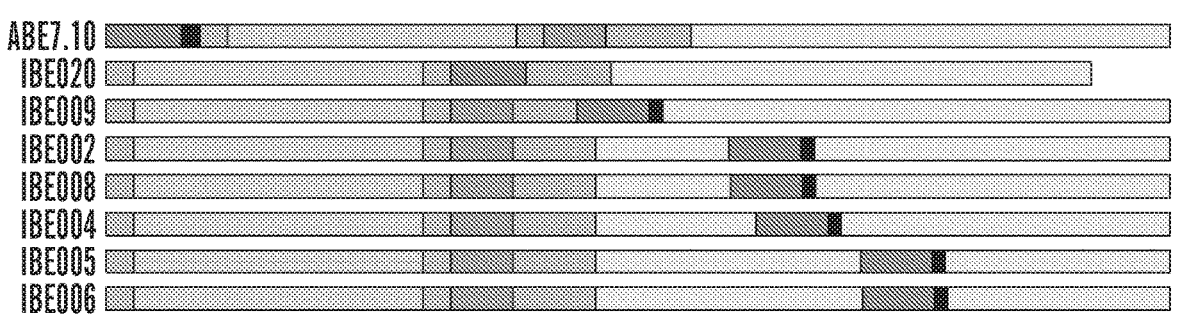
FIGS. 21A-B show schematics of exemplary base editors.
Figure 21B:
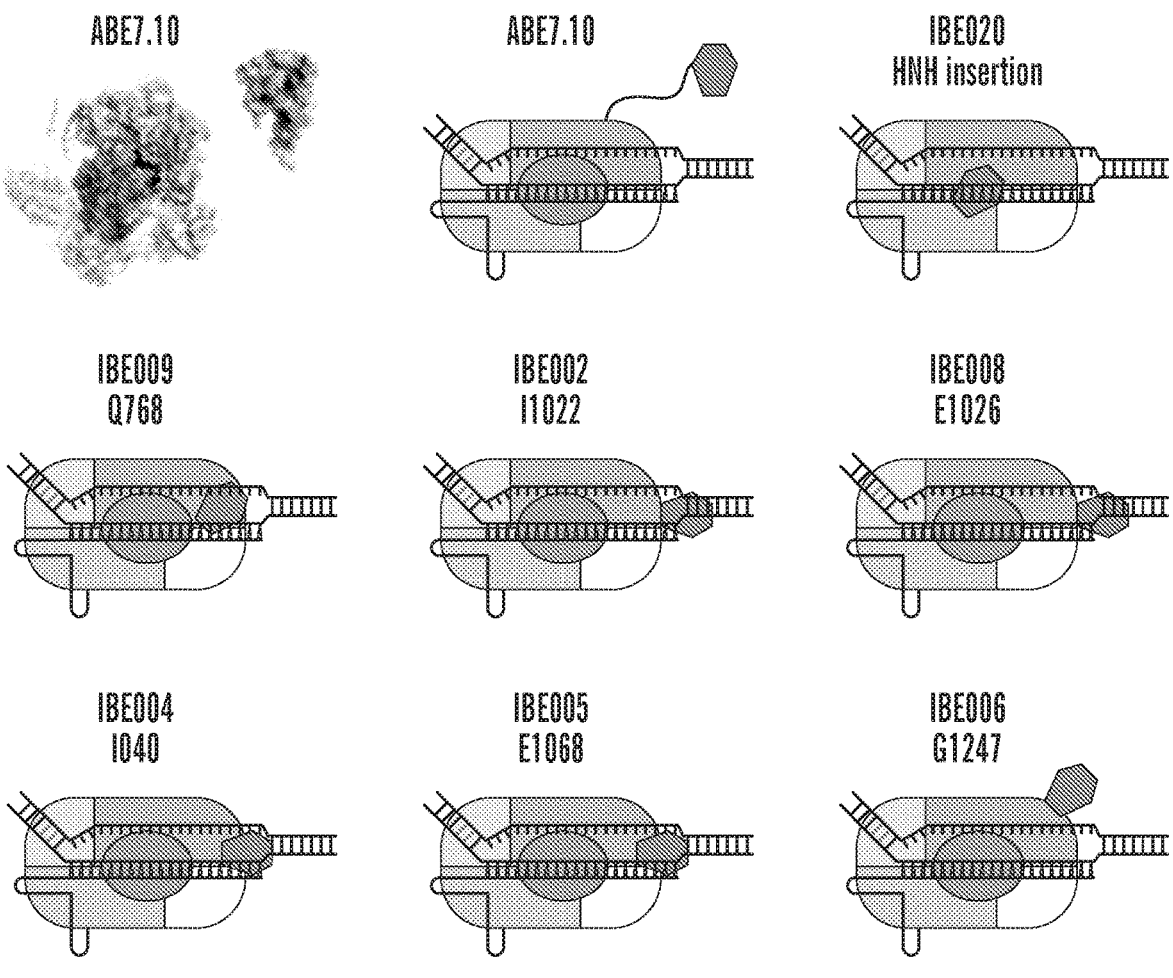

IBE003, IBE008, IBE007, IBE002, IBE001, IBE005, IBE006, IBE004, IBE021, IBE031, IBE020, IBE036, IBE035, IBE028, and IBE009 was used to determine the percent editing in two different target sequences, HEK2 (GAACACAAAGCATAGACTGC (SEQ ID NO: 95)) and T39 (GGACAGCTTTTCCTAGACAG (SEQ ID NO: 96)) (FIG. 20C-Q).

Example 6: Internal Fusion Base Editor Efficiency

HEK293T were co-transfected with 100 ng of a sgRNA-encoding plasmid and a base editor encoding plasmid using Lipofectamine® 2000 transfection reagent (Life Technologies) After 4 days, genomic DNA was isolated, and the targeted genomic region was amplified by PCR. Sequencing adaptors were added to generate a library of PCR products. The prepared PCR library containing the base-edited region was sequenced on an Illumina MiSeq® next generation sequencing instrument. Target sites used for this experiment are shown in Table 11 below.

TABLE 11

| Name | SEQ ID NO: | Sequence |
| --- | --- | --- |
| Target 1 | 233 | GGCCTCCGTATCACTCTCTGACTGGGGT |
| Target 2 | 234 | GTAACTGAACCCCTGCAATCAATGGGAT |
| Target 3 | 235 | GCCACAGACTTTTCCATTTGCAGGAGT |
| Target 4 | 236 | GCGAAAGGCTCGCGGCGAAGGAAGGAAT |
| Target 5 | 237 | GCCTGGCAGATGAGAACCAGGAGGAAT |
| Target 6 | 238 | GTATTACTATTATTATCTGAGATGGGGT |
| Target 7 | 239 | GCCACAGTGGGAGGGGACATGGGGAAT |
| Target 8 | 240 | GCCCTGATCTGCACTGAACAGAGGGGT |
| Target 9 | 241 | GCCTCAAGTCTGGTTATTTTAGGGGGAT |
| Target 10 | 242 | GGTCGACCCTTGGTATCCATGGGGGAT |
| Target 11 | 243 | GAAAGAGACAGAGAAGGGGCAGGGGGT |
| Target 12 | 244 | GAGTGGGAACTTTCTGATGCCATGGAAT |
| Target 13 | 245 | GTGGGACTGATCCCTTAATGTGTGGGGT |
| Target 14 | 246 | GCCCAGCTCCAGCCTCTGATGAGGGGT |
| Target 15 | 247 | GAAGGCTTTACTGTATTACAGAAGGGGT |
| Target 16 | 248 | GGAGCCAGAGACCAGTGGGCAGGGGGT |
| Target 17 | 249 | GCTTTCCTTAGCTGTAAAAGAAAGGGAT |
| Target 18 | 250 | GAGAAGAAACCAGGGAACAGGTAGGAGT |
| Target 19 | 233 | GGCCTCCGTATCACTCTCTGACTGGGGT |
| Target 20 | 251 | GATGTGTCTACTGTTACTTACAAGGAAT |
| Target 21 | 252 | GACCAGGICAGCAAACATGITTGGAAT |
| Target 22 | 253 | GCACCCAGGGGTTCTGCAGAGCAGGGAT |

TABLE 11-continued

| Name | SEQ ID NO: | Sequence |
| --- | --- | --- |
| Target 23 | 254 | GCCCAGCAATTCACTGTGAAGAGGGAT |
| Target 24 | 255 | GACCAAAACGAGGGACATTTAGGGGAT |
| Target 25 | 256 | GCTCCTCTCACCCTTATGACTCAGGGAT |
| Target 26 | 257 | GACTCAGCGCCCCTGCCGGGCCTGGGAT |
| Target 27 | 258 | GGTCGTAGCCAGTCCGAACCCCGGAGT |
| Target 28 | 259 | GCATTCCACTCCGTCCGCCTCCGGAGT |
| Target 29 | 260 | GGGTACCTGAGTGGGGTGCATTTGGGGT |

Figure 22A:
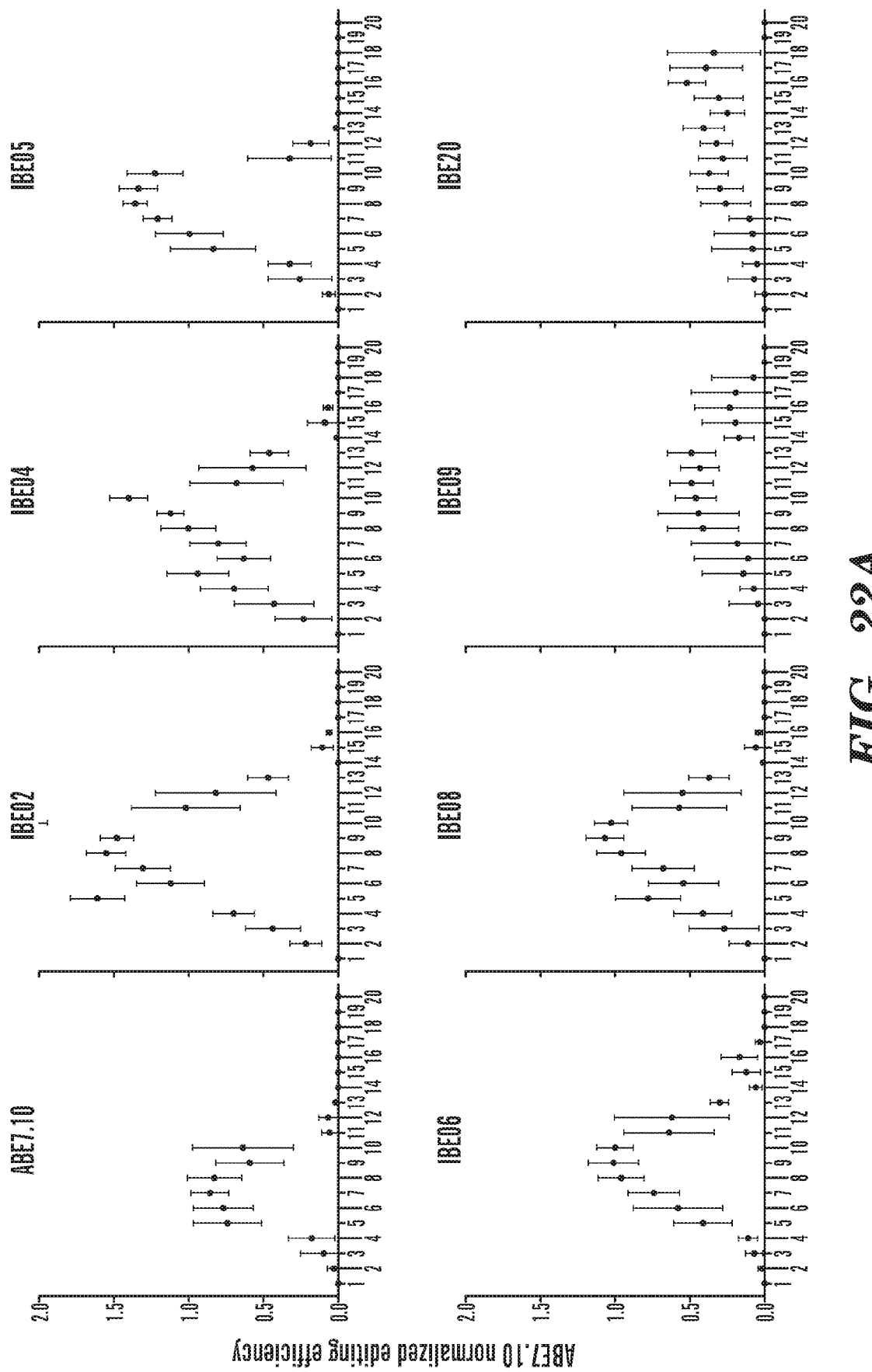
FIGS. 22A-D depict base editing efficiency of exemplary internal fusion base editors compared to ABE7.10 at 29 different genomic targets.
Figure 22B:
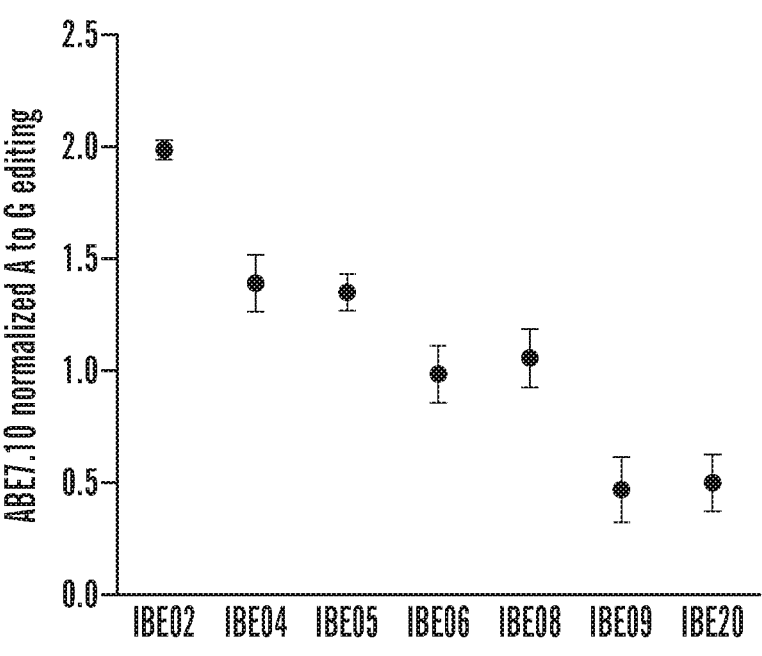
Figure 22C:
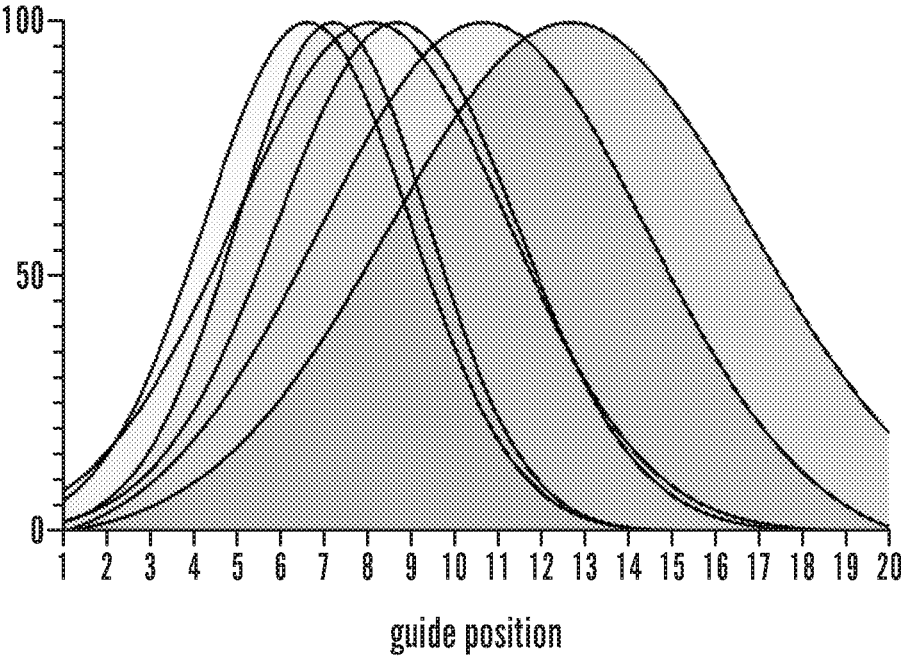
Figure 22D:
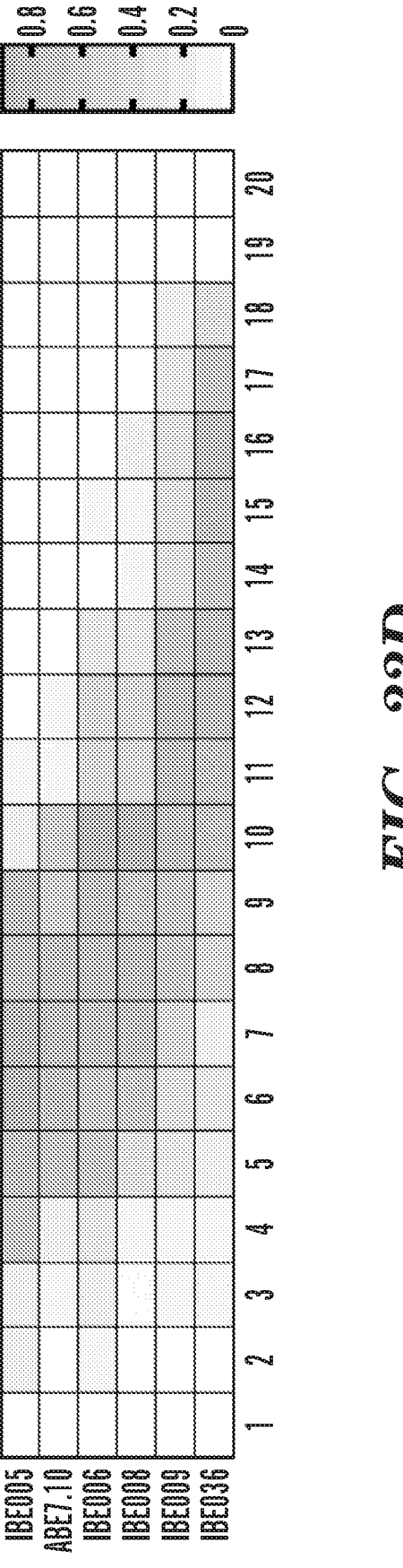
Figure 23:
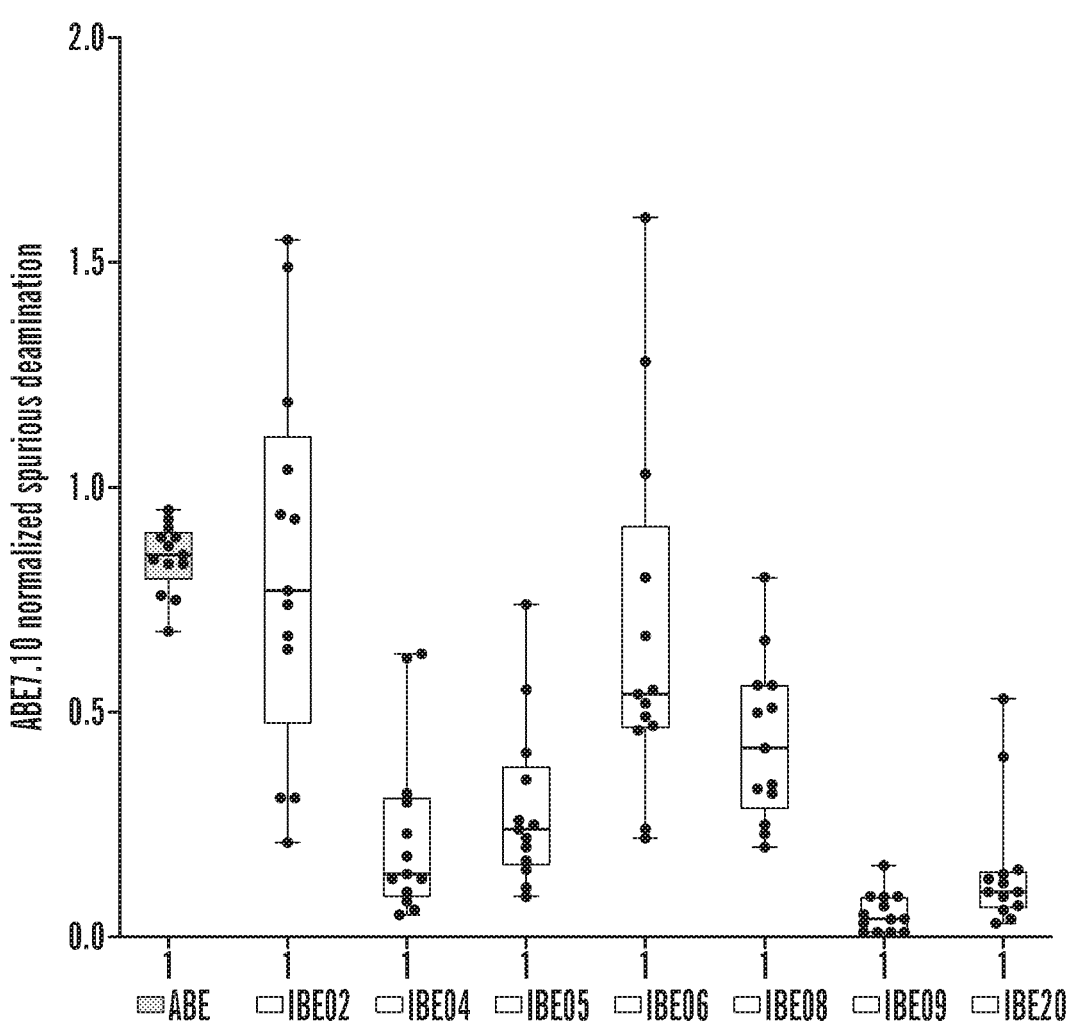
FIG. 23 depicts spurious deamination measured by trans editing assay as 29 different targets normalized to ABE7.10 at each site.

Sequencing reads were aligned to the original target sequence and the percent editing was measured. Referring to FIG. 22A, efficiency of internal fusions compared to ABE7.10 at 29 genomic targets was examined. Editing efficiency was normalized to ABE7.10 editing at the best position (position 14, with 20 being furthest from the PAM and 1 being closest to the PAM in this graph). The maximum editing efficiency of the internal base editors across all sites and is normalized to the maximum editing efficiency of ABE7.10 (FIG. 22B). Effective base editing window based on max editing efficiency normalized to ABE7.10 indicates altered max editing windows in internal fusion A base editors compared to ABE7.10 (FIG. 22C, D).

Example 7: Evaluation of Spurious Deamination of Internal Fusion Base Editors

Base editors with guide were transfected together with SaCas9 and guide targeting different loci. SaCas9 generates ssDNA which is subject to deamination by spurious base editing (spurious=not guide-targeted). The SaCas9 target loci was sequenced to measure spurious deamination. Trans-editing was normalized to ABE7.10 trans-editing at each site. Spurious deamination across 29 different IBE target was measured by trans-editing assay normalized to ABE7.10 trans-editing sites at each site for comparison. Total trans-editing was summed per site before normalizing to ABE7.10 trans-editing at that site. The tested internal base editors (IBE002, IBE004, IBE005, IBE006, IBE008, IBE009, IBE020) showed a reduced average spurious deamination compared to ABE7.10.

Example 8: Evaluation of Base Editing of Internal Fusion a Base Editors

Figure 24A:
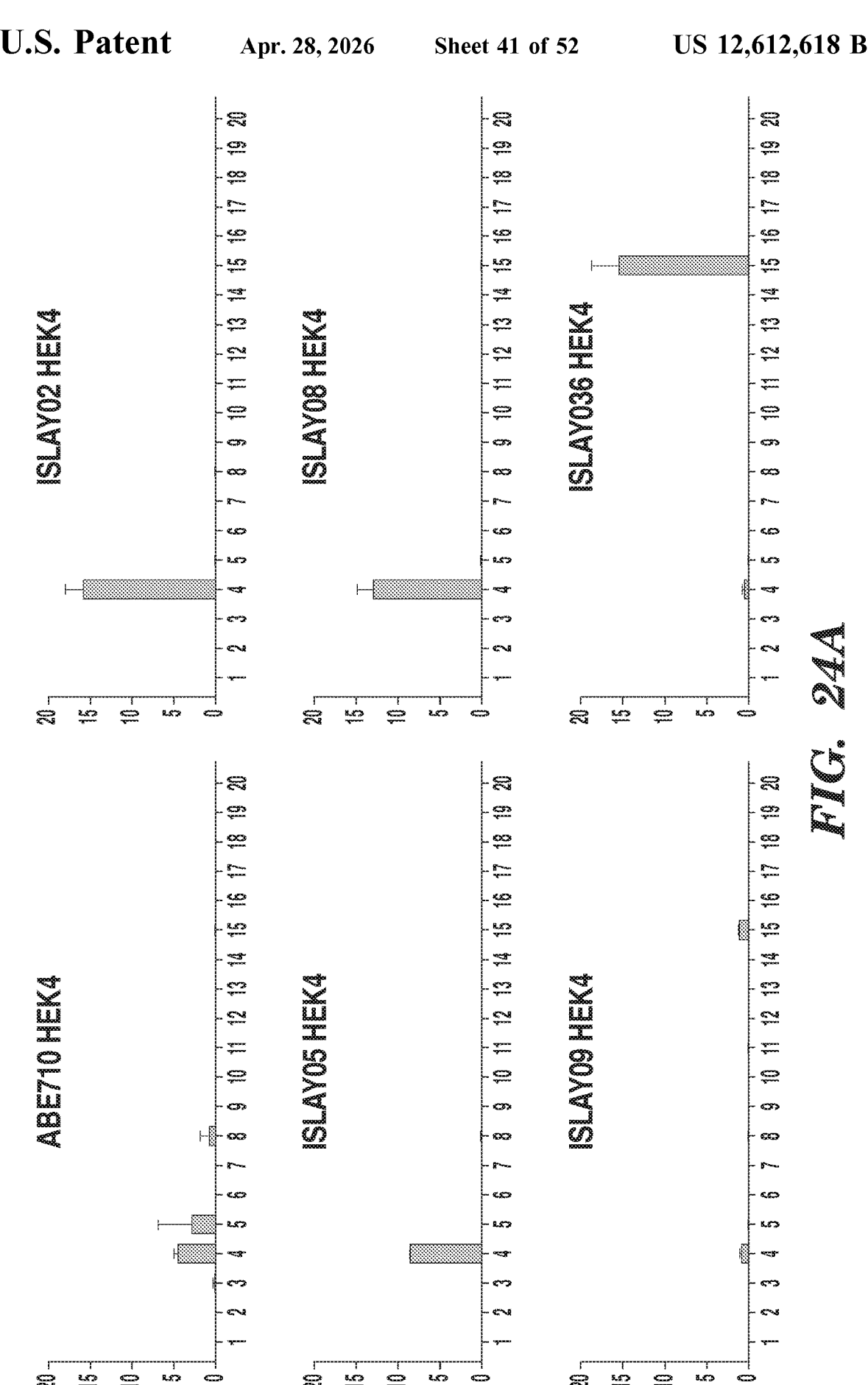
FIGS. 24A-F show the percent editing of A-base editors at 6 genomic loci: HEK4 (FIG. 24A), FANCF (FIG. 24B), HEK-3 (FIG. 24C), HEK2-YY (FIG. 24D), EMX1 (FIG. 24E), HEK2 (FIG. 24F). X-axis: nucleobase positions with 1 being furthest from the PAM and 20 being PAM proximal (PAM being positions 21-23). Y axis: percentage of A to G editing measured by Illumina sequencing.
Figure 24B:
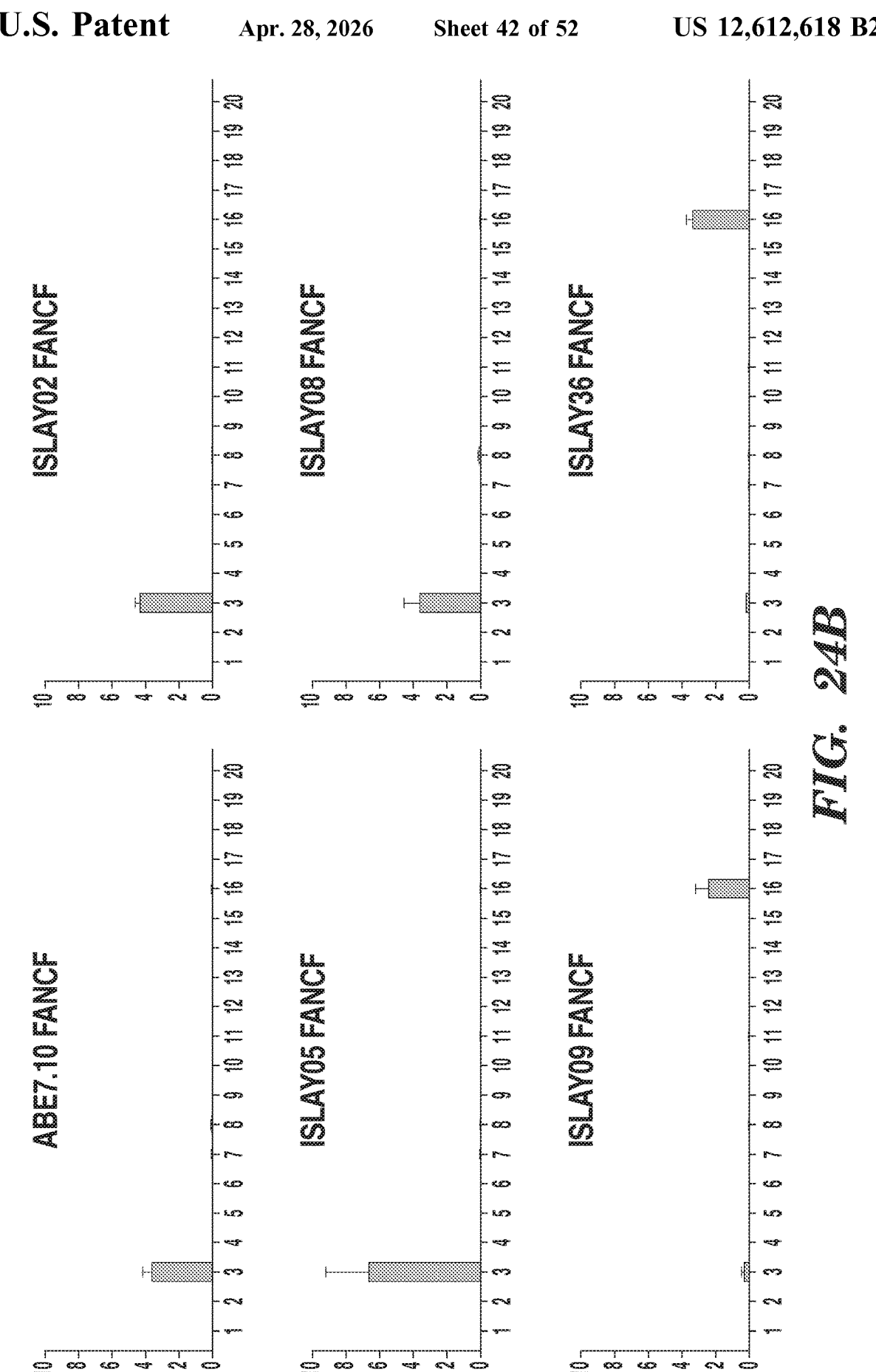
Figure 24C:
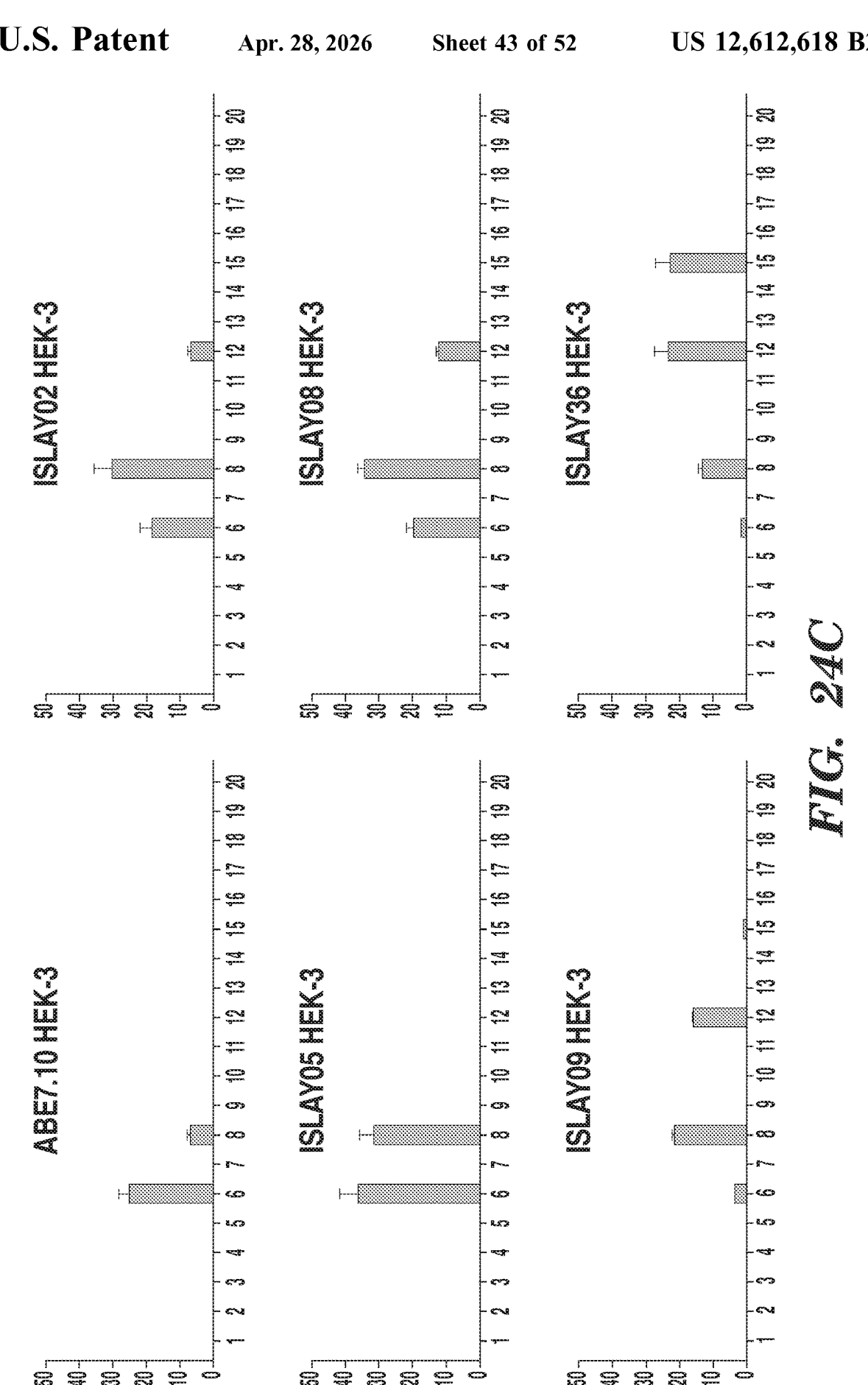
Figure 24D:
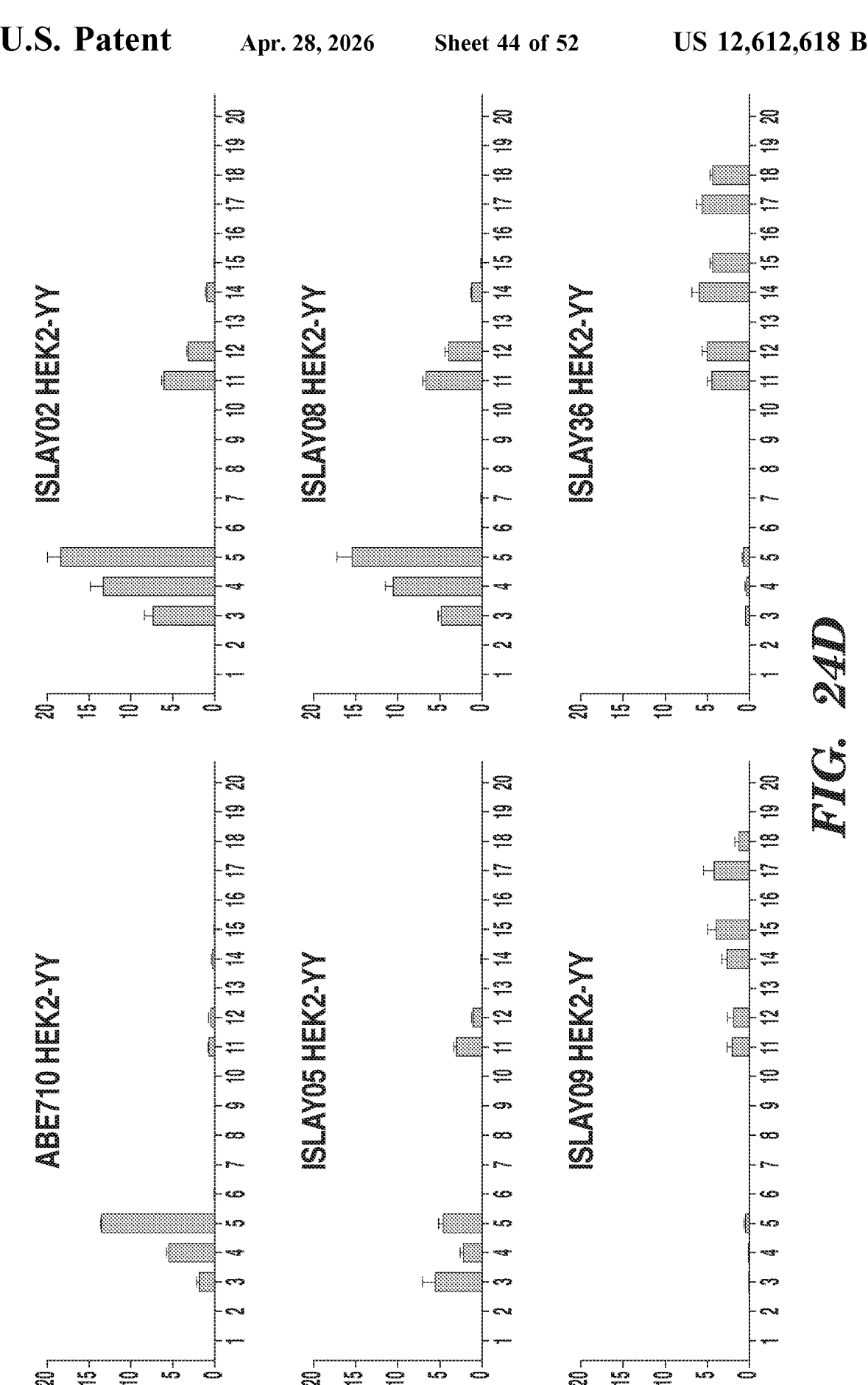
Figure 24E:
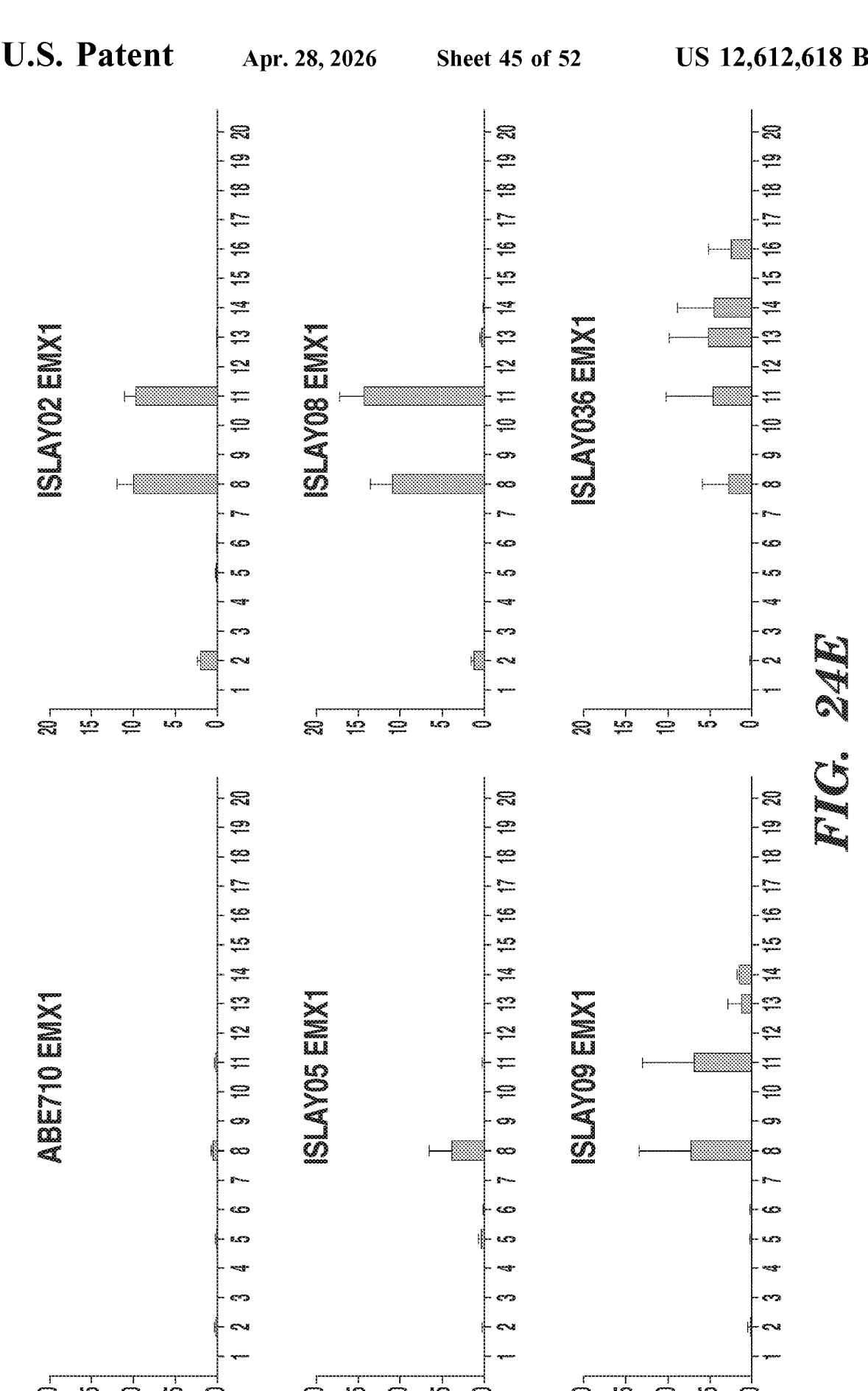
Figure 24F:
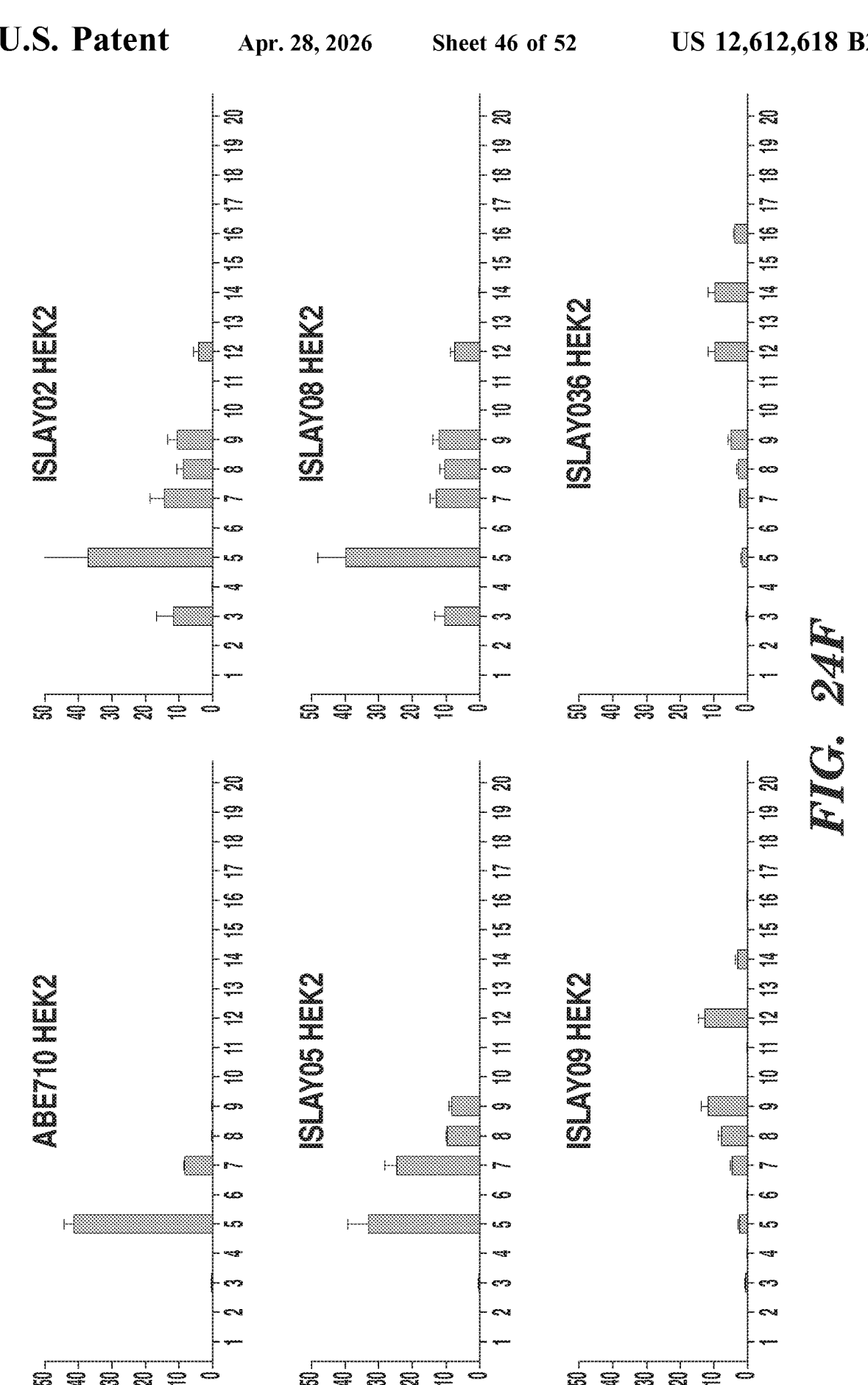

Base editing using ABE internal fusions was evaluated using HEK293T cells as described in Example 6 using high-throughput sequencing. In this assay, guides were designed to target 6 different sites HEK4, GGCACTGCGGCTGGAGGTGG (SEQ ID NO: 261) (FIG. 24A); FANCF, GTAGGGCCTTCGCGCACCTCA (SEQ ID NO: 210) (FIG. 24B); HEK-3, GGCCCAGACT-GAGCACGTGA (SEQ ID NO: 193) (FIG. 24C); HEK2-YY, GGAAACCTTGAATAAGAATGGA (SEQ ID NO: 191) (FIG. 24D); EMX1, GAGTCCGAGCAGAAGAAGAA (SEQ ID NO: 192) (FIG. 24E), and HEK2, GAACACAAAGCATAGACTGC (SEQ ID NO: 95) (FIG. 24F).

10,000-20,000 HEK293T cells were seeded per well. 75 ng of sgRNA and 175 ng of base editor or Cas9 plasmid was transfected with 1 PI of Lipofectamine® 2000 transfection reagent. Four days after transfection, genomic DNA was isolated, and the target site was PCR amplified and sequenced on an Illumina MiSeq® next generation sequencing instrument. Percent editing was calculated by the percent of 40,000 Illumina sequencing reads that have an A mutations to a G at a noted position. Internal fusion adenosine base editors exhibit different max editing window and reduced off-target editing compared to ABE7.10. (FIGS. 24A-F).

Example 9: Evaluation of Base Editing of Internal Fusion C Base Editors

Figure 25A:
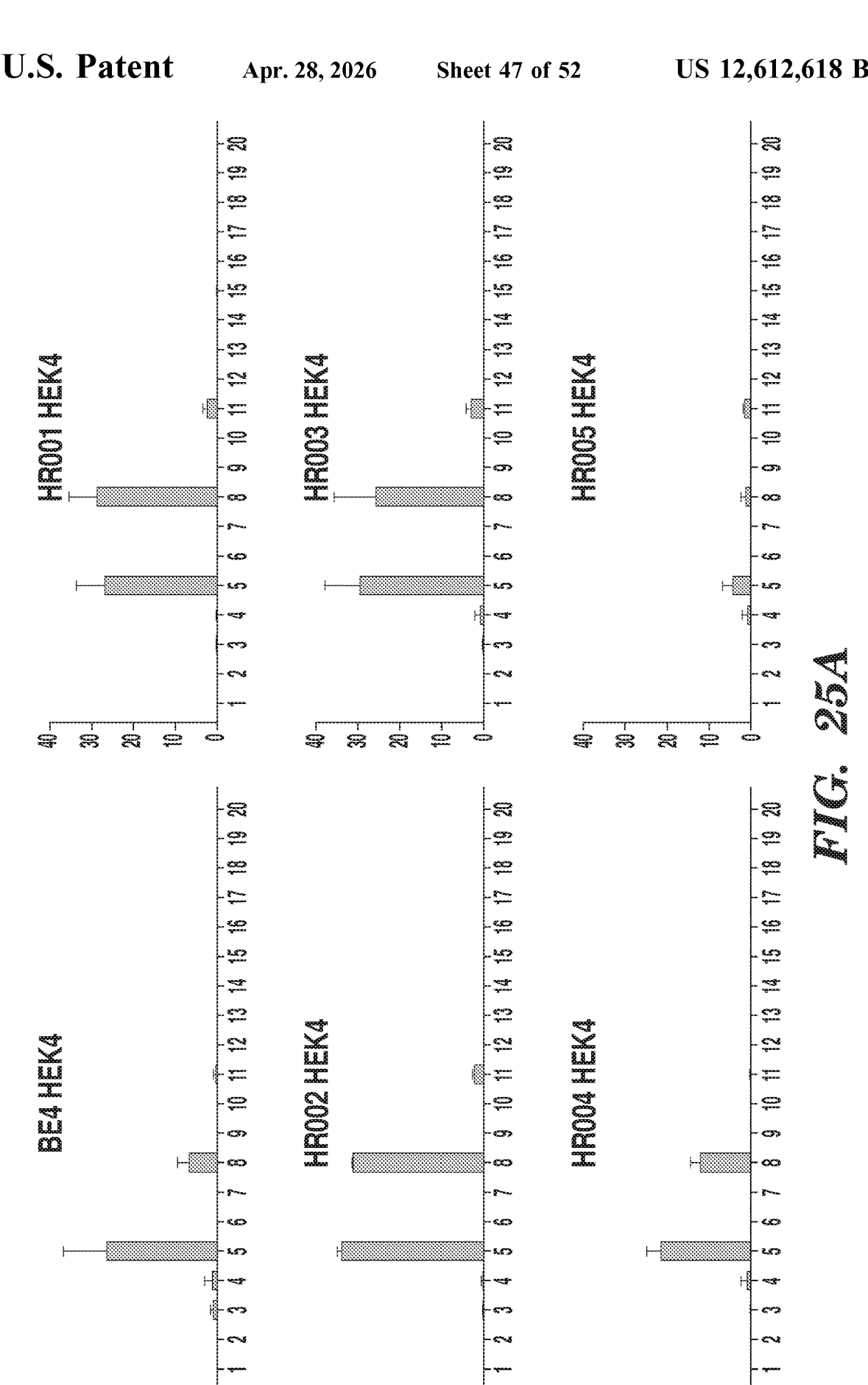
FIGS. 25A-F Percent editing of C-base editors at 6 genomic loci: HEK4 (FIG. 25A), FANCF (FIG. 25B), HEK-3 (FIG. 25C), HEK2-YY (FIG. 25D), EMX1 (SEQ ID NO: 192) (FIG. 25E), HEK2 (FIG. 25F). X-axis: nucleobase positions with 1 being furthest from the PAM and 20 being PAM proximal (PAM being positions 21-23). Y axis: percentage of A to G editing measured by Illumina sequencing.
Figure 25B:
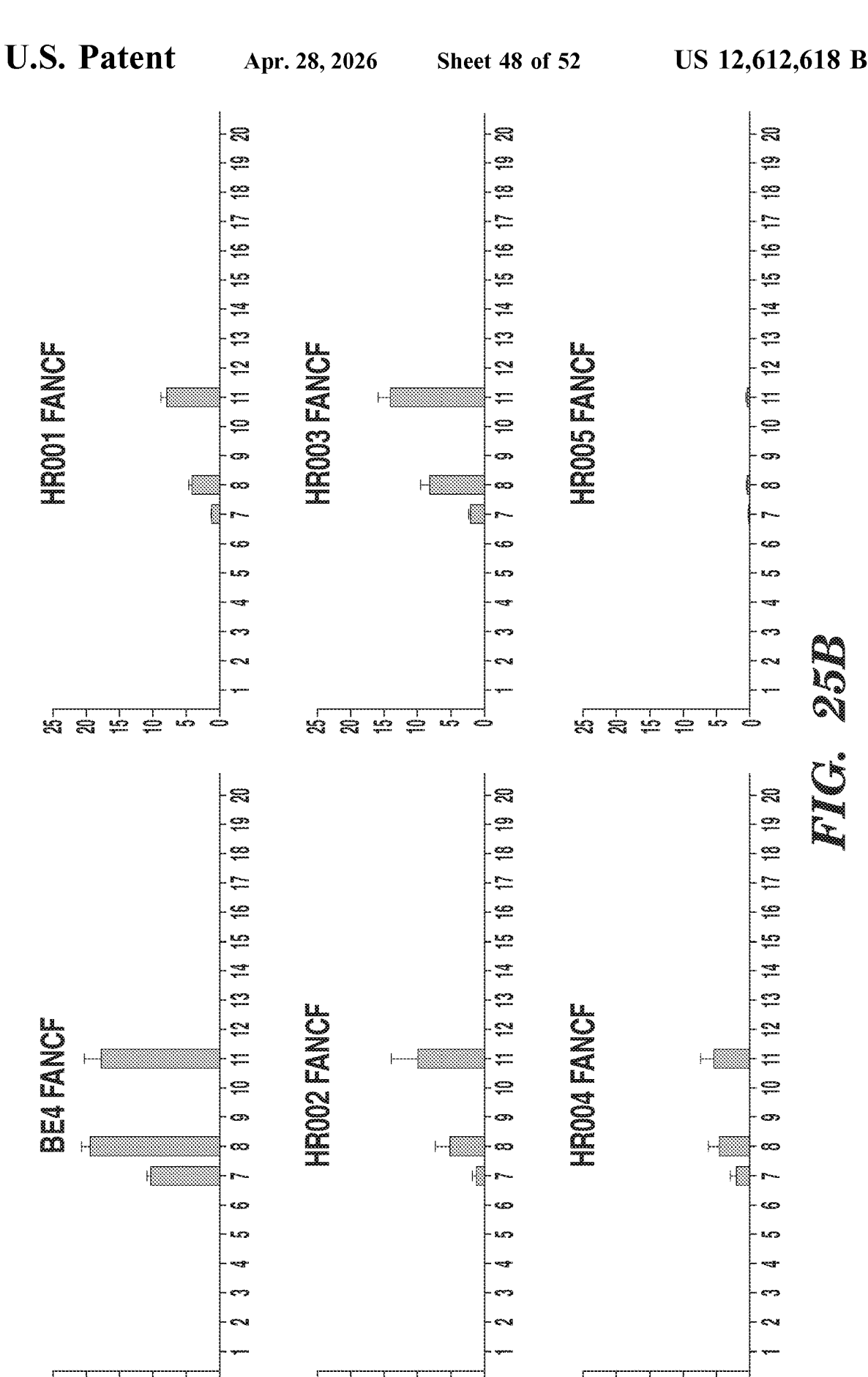
Figure 25C:
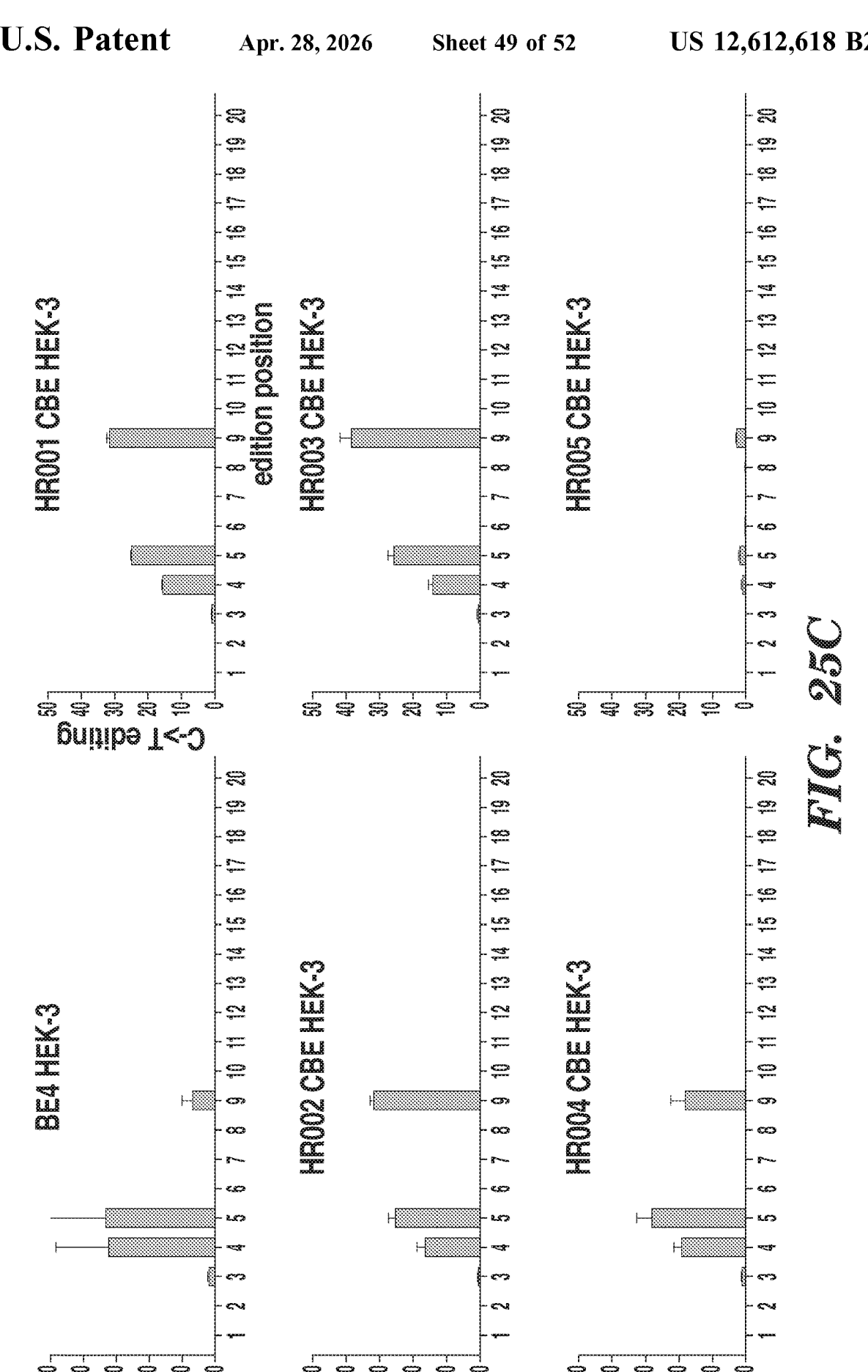
Figure 25D:
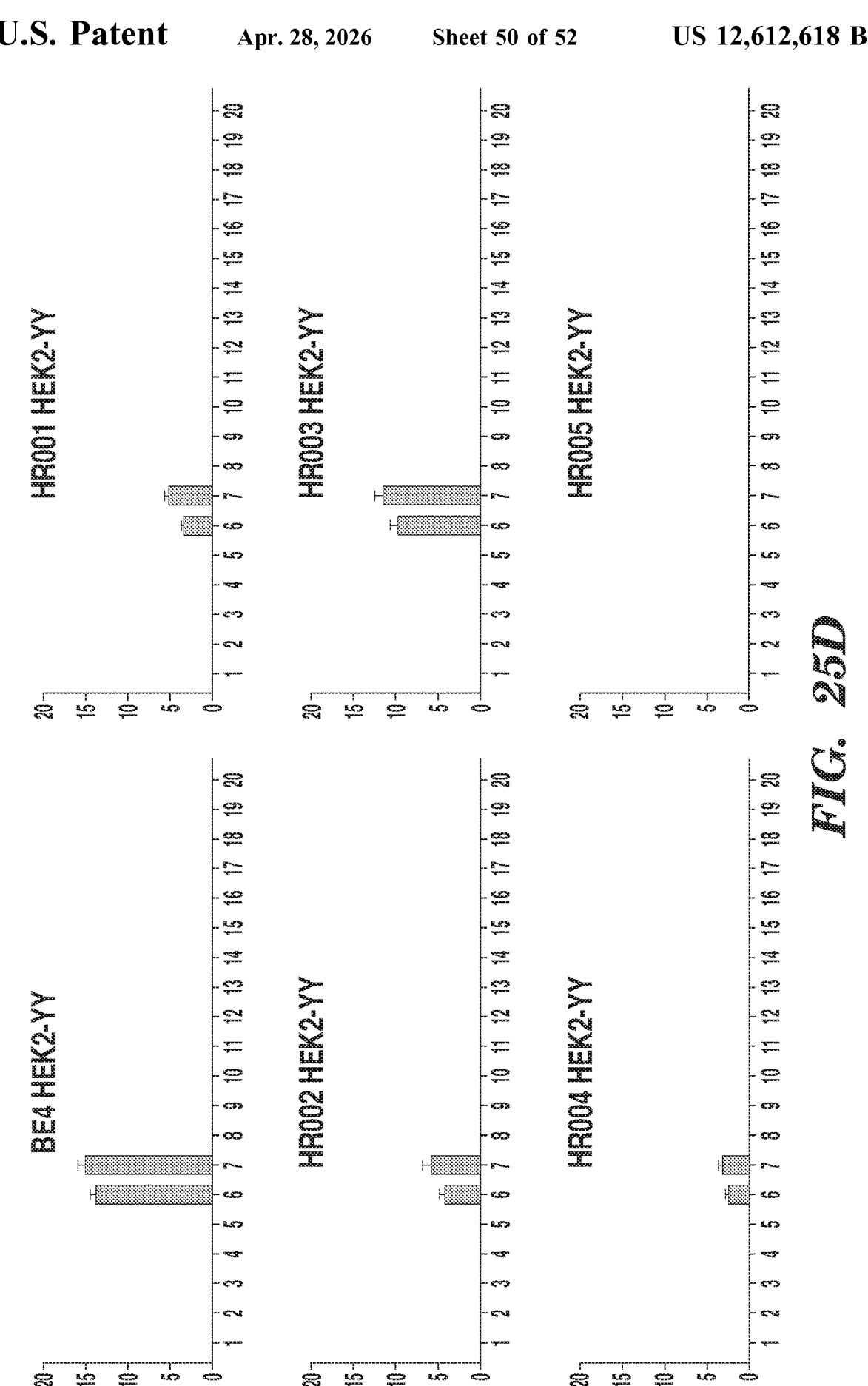
Figure 25E:
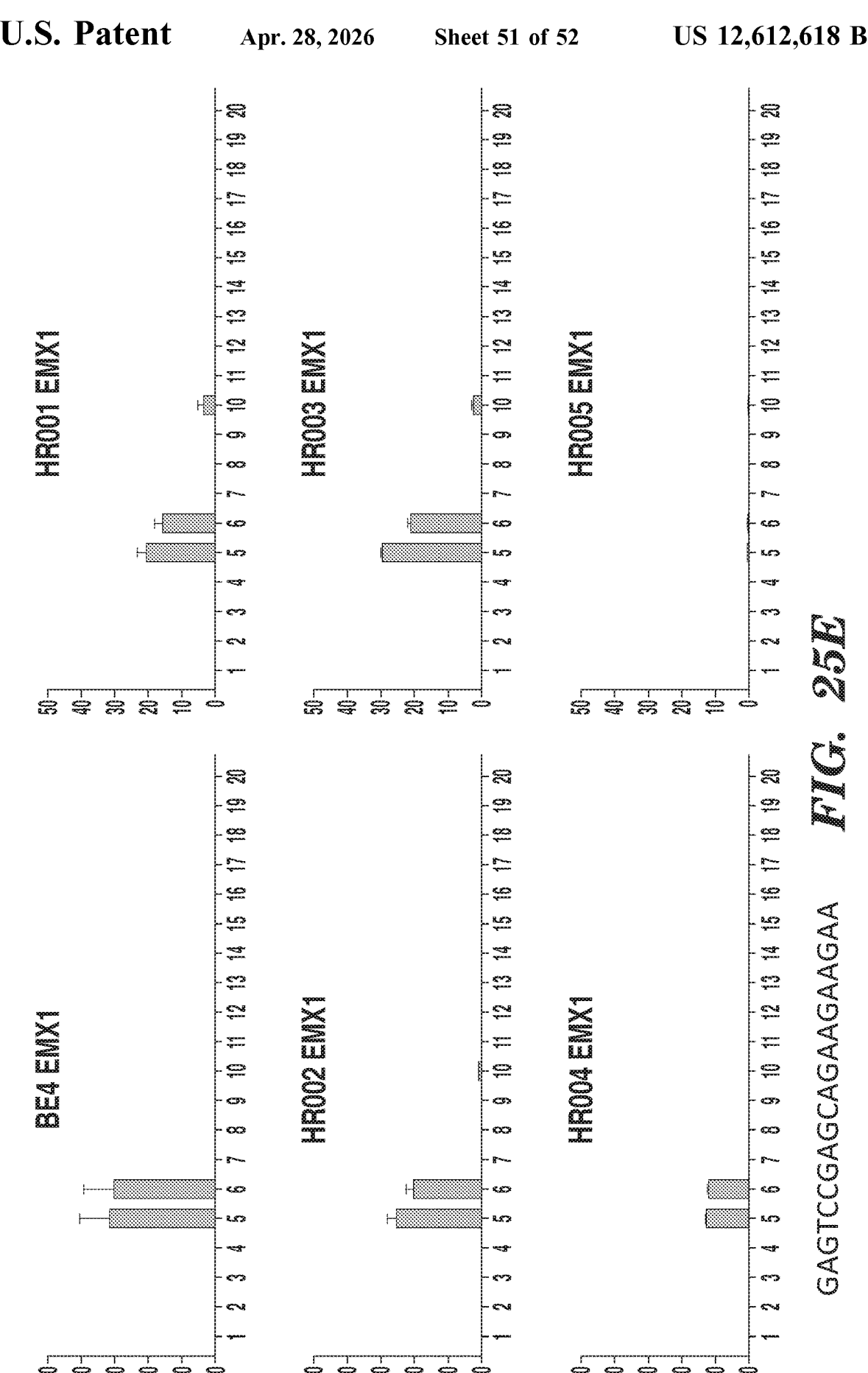
Figure 25F:
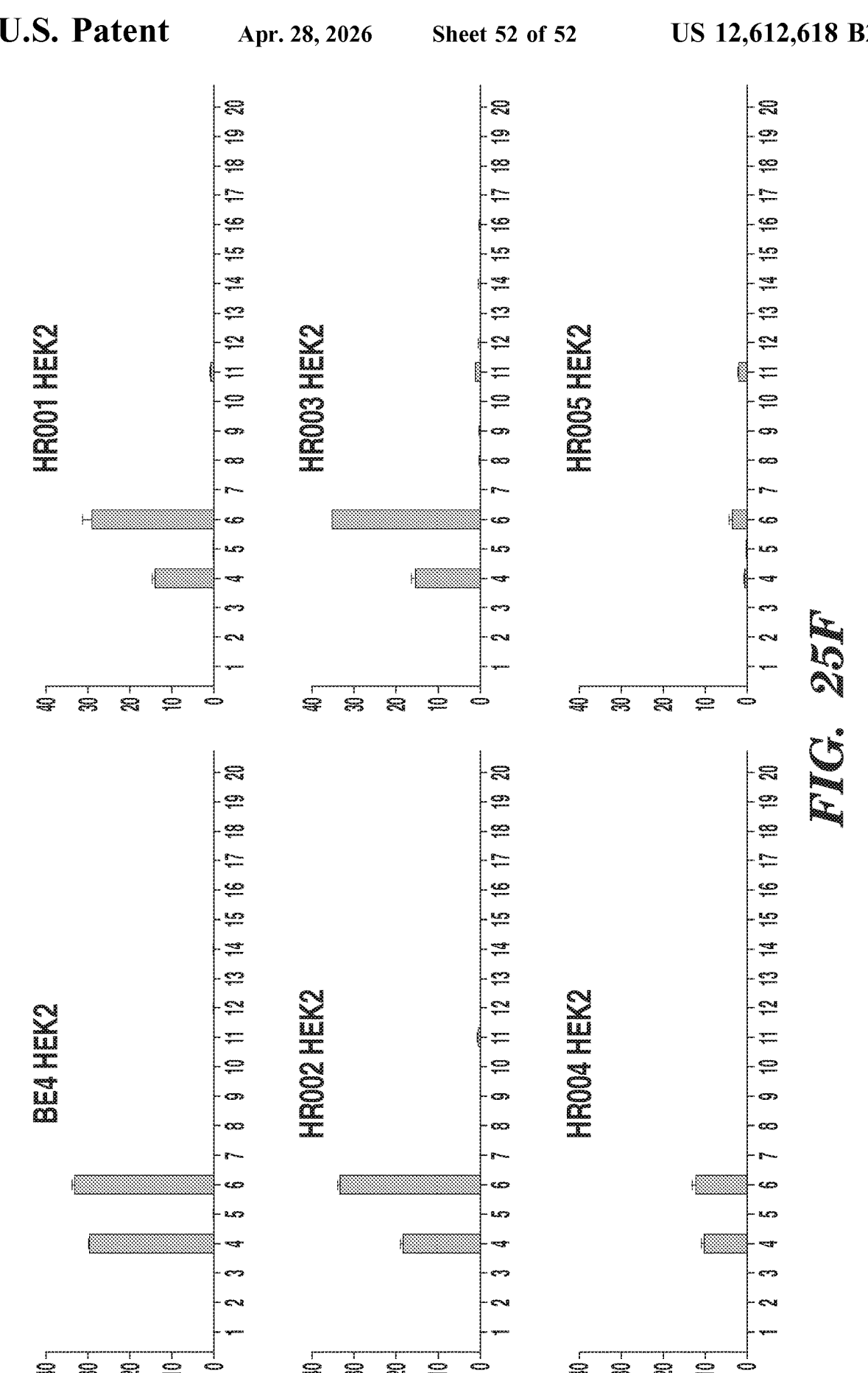

Base editing using CBE internal fusions was evaluated using HEK293T cells as described in Example 6 using high-throughput sequencing. In this assay the following CBE base editors were used, BE4, HR001, HR002, HR003, HR004, HR005. In this assay, guides were designed to target 6 different sites HEK4, GGCACTGCGGCTGGAGGTGG (SEQ ID NO: 261) (FIG. 25A); FANCF, GTAGGGCCTTCGCGCACCTCA (SEQ ID NO: 210) (FIG. 25B); HEK-3, GGCCCAGACTGAGCACGTGA (SEQ ID NO: 193) (FIG. 25C); HEK2-YY, GGAAACCTT-GAATAAGAATGGA (SEQ ID NO: 191) (FIG. 25D); EMX1, GAGTCCGAGCAGAAGAAGAA (SEQ ID NO: 192) (FIG. 25E), and HEK2, GAACACAAAGCATA-GACTGC (SEQ ID NO: 95) (FIG. 25F). Percent editing was calculated by the percent of 40,000 Illumina sequencing reads that have an C mutations to a T at a noted position. Internal fusion cytidine base editors exhibit different max editing window and reduced off-target editing compared to ABE7.10. (FIGS. 24A-F).

The following numbered additional embodiments encompassing the methods and compositions of the base editor systems and uses are envisioned herein:

1. A fusion protein comprising a deaminase flanked by a N-terminal fragment and a C-terminal fragment of a Cas9 polypeptide, wherein the deaminase of the fusion protein deaminates a target nucleobase in a target polynucleotide sequence, wherein the N terminal fragment or the C terminal fragment binds the target polynucleotide sequence, and wherein the C-terminus of the N terminal fragment or the N-terminus of the C terminal fragment comprises a part of a flexible loop of the Cas9 polypeptide.

2. The fusion protein of embodiment 1, wherein the target nucleobase is deaminated with lower off-target deamination as compared to an end terminus fusion protein comprising the deaminase fused to a N terminus or a C terminus of SEQ ID NO: 1.

3. The fusion protein of embodiment 1 or 2, wherein the target nucleobase is 1-20 nucleobases away from a Protospacer Adjacent Motif (PAM) sequence in the target polynucleotide sequence.

4. The fusion protein of embodiment 3, wherein the target nucleobase is 2-12 nucleobases upstream of the PAM sequence.

5. The fusion protein of any one of embodiments 1-4, wherein the C-terminus of the N terminal fragment or the N-terminus of the C terminal fragment comprises an amino acid in proximity to the target nucleobase when the fusion protein deaminates the target nucleobase.

6. The fusion protein of any one of embodiments 1-4, wherein the C-terminus of the N terminal fragment or the N-terminus of the C terminal fragment comprises a part of an alpha-helix structure of the Cas9 polypeptide.

7. The fusion protein of any one of embodiments 1-4, wherein the N-terminal fragment or the C-terminal fragment comprises a DNA binding domain.

8. The fusion protein of any one of embodiments 1-4, wherein the N-terminal fragment or the C-terminal fragment comprises a RuvC domain.

9. The fusion protein of any one of embodiments 1-4, wherein neither of the N-terminal fragment and the C-terminal fragment comprises a HNH domain.

10. The fusion protein of any one of embodiments 1-4, wherein the flexible loop of the Cas9 polypeptide comprises an amino acid at a position between 530-537, 569-579, 686-691, 768-793, 943-947, 1002-1040, 1052-1077, 1232-1248, or 1298-1300 as numbered in SEQ ID NO: 1 or corresponding positions thereof.

11. The fusion protein of embodiment 10, wherein the N-terminal fragment starts at the N-terminus of the Cas9 polypeptide and is a contiguous sequence that terminates at a position between 1-529, 538-568, 580-685, 692-942, 948-1001, 1026-1051, 1078-1231, or 1248-1297 as numbered in SEQ ID NO: 1 or corresponding positions thereof.

12. The fusion protein of embodiment 10, wherein the C-terminal fragment starts at a position between 1301-1368, 1248-1297, 1078-1231, 1026-1051, 948-1001, 692-942, 580-685, or 538-568 as numbered in SEQ ID NO: 1 and is a contiguous sequence that terminates at the C-terminus of the Cas9 polypeptide.

13. The fusion protein of embodiment 10, wherein the C-terminal amino acid of the N-terminal fragment is amino acid 1016, 1023, 1029, 1040, 1069, or 1247 as numbered in SEQ ID NO: 1 or a corresponding amino acid thereof.

14. The fusion protein of embodiment 10, wherein the N-terminal amino acid of the C-terminal fragment is amino acid 1017, 1024, 1030, 1041, 1070, 1248 as numbered in SEQ ID NO: 1 or a corresponding amino acid thereof.

15. The fusion protein of any one of embodiments 11-14, wherein the deaminase is a cytidine deaminase.

16. The fusion protein of embodiment 10, wherein the N-terminal fragment starts at the N-terminus of the Cas9 polypeptide and is a contiguous sequence that terminates at a position between 530-537, 569-579, 686-691, 768-793, 943-947, 1002-1040, 1052-1077, 1232-1248, or 1298-1300 as numbered in SEQ ID NO: 1 or corresponding positions thereof.

17. The fusion protein of embodiment 10, wherein the C-terminal fragment starts at a position between 530-537, 569-579, 686-691, 768-793, 943-947, 1002-1040, 1052-1077, 1232-1248, or 1298-1300 as numbered in SEQ ID NO: 1 and is a contiguous sequence that terminates at the C-terminus of the Cas9 polypeptide.

18. The fusion protein of embodiment 10, wherein the C-terminal amino acid of the N-terminal fragment is amino acid 1022, 1029, 1040, 1068, 1069, 1247, 1054, 1026, 768, 791, 792, 1248, 1052, or 1246 as numbered in SEQ ID NO: 1 or a corresponding amino acid thereof.

19. The fusion protein of embodiment 10, wherein the N-terminal amino acid of the C-terminal fragment is amino acid 1023, 1030, 1041, 1069, 1070, 1248, 1055, 1026, 769, 792, 793, 873, 907, 1249, 1053, or 1247 as numbered in SEQ ID NO: 1 or a corresponding amino acid thereof.

20. The fusion protein of any one of embodiments 16-19, wherein the deaminase is an adenosine deaminase.

21. The fusion protein of any one of embodiments 1-20, further comprising an additional catalytic domain.

22. The fusion protein of embodiment 21, wherein the additional catalytic domain is a cytidine deaminase or an adenosine deaminase.

23. The fusion protein of any one of embodiments 1-22 further comprising a linker between the N-terminal fragment and the deaminase.

24. The fusion protein of any one of embodiments 1-22 further comprising a linker between the C-terminal fragment and the deaminase.

25. The fusion protein of any one of embodiments 1-22 further comprising a nuclear localization signal.

26. The fusion protein of embodiment 25, wherein the nuclear localization signal is a bipartite nuclear localization signal.

27. The fusion protein of any one of embodiments 1-26, wherein the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or variants thereof.

28. The fusion protein of any one of embodiments 1-27, wherein the Cas9 polypeptide is a modified Cas9 and has specificity for an altered PAM.

29. The fusion protein of any one of embodiments 1-28, wherein the Cas9 polypeptide is a nickase.

30. The fusion protein of any one of embodiments 1-28, wherein the Cas9 polypeptide is nuclease inactive.

31. The fusion protein of any one of embodiments 1-30 in complex with a guide nucleic acid sequence to effect deamination of the target nucleobase.

32. A protein library for optimized base editing comprising a plurality of fusion proteins, wherein each one of the plurality of fusion proteins comprises a deaminase flanked by a N-terminal fragment and a C-terminal fragment of a Cas9 polypeptide, wherein the N-terminal fragment of each one of the fusion proteins differs from the N-terminal fragments of the rest of the plurality of fusion proteins or wherein the C-terminal fragment of each one of the fusion proteins differs from the C-terminal fragments of the rest of the plurality of fusion proteins, wherein the deaminase of each one of the fusion proteins deaminates a target nucleobase in proximity to a Protospacer Adjacent Motif (PAM) sequence in a target polynucleotide sequence, and wherein the N terminal fragment or the C terminal fragment binds the target polynucleotide sequence.

33. The protein library of embodiment 32, wherein for each nucleobase from 1 to 20 nucleobases away of the PAM sequence, at least one of the plurality of fusion proteins deaminates the nucleobase.

34. The protein library of embodiment 32, wherein the C-terminus of the N terminal fragment or the N-terminus of the C terminal fragment of the Cas9 polypeptide of each one of the plurality of fusion proteins comprises a part of a flexible loop of the Cas9 polypeptide.

35. The protein library of any one of embodiments 32-34, wherein at least one of the plurality of fusion proteins deaminates the target nucleobase with lower off-target deamination as compared to an end terminus fusion protein comprising the deaminase fused to a N terminus or a C terminus of SEQ ID NO: 1.

36. The protein library of anyone of embodiments 32-35, wherein at least one of the plurality of the fusion proteins deaminates a target nucleobase 2-12 nucleobases upstream of the PAM sequence.

37. The protein library of any one of embodiments 32-36, wherein the C-terminus of the N terminal fragment or the N-terminus of the C terminal fragment of a fusion protein of the plurality comprises an amino acid in proximity to the target nucleobase when the fusion protein deaminates the target nucleobase.

38. The protein library of any one of embodiments 34-36, wherein the flexible loop of the Cas9 polypeptide comprises an amino acid at a position between 530-537, 569-579, 686-691, 768-793, 943-947, 1002-1040, 1052-1077, 1232-1248, or 1298-1300 as numbered in SEQ ID NO: 1 or corresponding positions thereof 39. The protein library of embodiment 38, wherein the plurality of fusion proteins comprise a fusion protein that comprises a N-terminal fragment starting at the N-terminus of the Cas9 polypeptide and is a contiguous sequence that terminates at a position between 530-537, 569-579, 686-691, 768-793, 943-947, 1002-1040, 1052-1077, 1232-1248, or 1298-1300 as numbered in SEQ ID NO: 1 or corresponding positions thereof 40. The protein library of embodiment 38, wherein the plurality of fusion proteins comprise a fusion protein that comprises a C-terminal fragment starting at a position between 530-537, 569-579, 686-691, 768-793, 943-947, 1002-1040, 1052-1077, 1232-1248, or 1298-1300 as numbered in SEQ ID NO: 1 or corresponding positions thereof and is a contiguous sequence that terminates at the C-terminus of the Cas9 polypeptide.

41. The protein library of any one of embodiments 38-40, wherein the C-terminal amino acid of the N-terminal fragment is amino acid 1022, 1029, 1040, 1068, 1069, 1247, 1054, 1026, 768, 791, 792, 1248, 1052, or 1246 as numbered in SEQ ID NO: 1 or a corresponding amino acid thereof.

42. The protein library of any one of embodiments 38-40, wherein the N-terminal amino acid of the C-terminal fragment is amino acid 1023, 1030, 1041, 1069, 1070, 1248, 1055, 1026, 769, 792, 793, 873, 907, 1249, 1053, or 1247 as numbered in SEQ ID NO: 1 or a corresponding amino acid thereof.

43. The protein library of any one of embodiments 32-42, wherein the deaminase is an adenosine deaminase.

44. The protein library of any one of embodiments 32-42, wherein the deaminase is a cytidine deaminase.

45. The protein library of any one of embodiments 32-44, wherein the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or variants thereof.

46. The protein library of any one of embodiments 32-45, wherein the Cas9 polypeptide is a modified Cas9 and has specificity for an altered protospacer-adjacent motif (PAM).

47. The protein library of any one of embodiments 32-46, wherein the Cas9 polypeptide is a nickase.

48. The protein library of any one of embodiments 32-46, wherein the Cas9 polypeptide is nuclease inactive.

49. A cell comprising the fusion protein of any one of embodiments 1-31.

50. The cell of embodiment 49, wherein the cell is a mammalian cell or a human cell.

51. A method for editing a target nucleobase in a target polynucleotide sequence, the method comprising: contacting the target polynucleotide with a fusion protein comprising a deaminase flanked by a N-terminal fragment and a C-terminal fragments of a Cas9 polypeptide, wherein the deaminase of the fusion protein deaminates the target nucleobase in the target polynucleotide sequence, wherein the N terminal fragment or the C terminal fragment binds the target polynucleotide sequence, and wherein the C-terminus of the N terminal fragment or the N-terminus of the C terminal fragment comprises a part of a flexible loop of the Cas9 polypeptide.

52. The method of embodiment 51, further comprising contacting the target polynucleotide sequence with a guide nucleic acid sequence to effect deamination of the target nucleobase.

53. The method of embodiment 52, wherein the guide nucleic acid sequence comprises a spacer sequence complementary to a protospacer sequence of the target polynucleotide sequence, thereby forming a R-loop.

54. The method of embodiment 53, wherein the target nucleobase is deaminated with lower off-target deamination as compared to an end terminus method comprising the deaminase fused to a N terminus or a C terminus of SEQ ID NO: 1.

55. The method of embodiment 54, wherein the deaminase of the fusion protein deaminates no more than two nucleobases within the range of the R-loop.

56. The method of any one of embodiments 51-55, wherein the target nucleobase is 1-20 nucleobases away from a PAM sequence in the target polynucleotide sequence.

57. The method of embodiment 55, wherein the target nucleobase is 2-12 nucleobases upstream of the PAM sequence.

58. The method of any one of embodiments 51-57, wherein the C-terminus of the N terminal fragment or the N-terminus of the C terminal fragment comprises an amino acid in proximity to the target nucleobase when the deaminase of the fusion protein deaminates the target nucleobase.

59. The method of any one of embodiments 51-57, wherein the N-terminal fragment or the C-terminal fragment comprises a RuvC domain.

60. The method of any one of embodiments 51-57, wherein neither of the N-terminal fragment and the C-terminal fragment comprises a HNH domain.

61. The method of any one of embodiments 51-57, wherein the flexible loop of the Cas9 polypeptide comprises an amino acid at a position between 530-537, 569-579, 686-691, 768-793, 943-947, 1002-1040, 1052-1077, 1232-1248, or 1298-1300 as numbered in SEQ ID NO: 1 or corresponding positions thereof.

62. The method of embodiment 61, wherein the N-terminal fragment starts at the N-terminus of the Cas9 polypeptide and is a contiguous sequence that terminates at a position between 530-537, 569-579, 686-691, 768-793, 943-947, 1002-1040, 1052-1077, 1232-1248, or 1298-1300 as numbered in SEQ ID NO: 1 or corresponding positions thereof.

63. The method of embodiment 61, wherein the C-terminal fragment starts at a position between 530-537, 569-579, 686-691, 768-793, 943-947, 1002-1040, 1052-1077, 1232-1248, or 1298-1300 as numbered in SEQ ID NO: 1 as numbered in SEQ ID NO: 1 or corresponding positions thereof and is a contiguous sequence that terminates at the C-terminus of the Cas9 polypeptide.

64. The method of embodiment 61, wherein the C-terminal amino acid of the N-terminal fragment is amino acid 1016, 1023, 1029, 1040, 1069, or 1247 as numbered in SEQ ID NO: 1 or a corresponding amino acid thereof.

65. The method of embodiment 61, wherein the N-terminal amino acid of the C-terminal fragment is amino acid 1017, 1024, 1030, 1041, 1070, 1248 as numbered in SEQ ID NO: 1 or a corresponding amino acid thereof.

66. The method of any one of embodiments 62-65, wherein the deaminase is a cytidine deaminase.

67. The method of embodiment 61, wherein the N-terminal fragment starts at the N-terminus of the Cas9 polypeptide and is a contiguous sequence that terminates at a position between 1-529, 538-568, 580-685, 692-942, 948-1001, 1026-1051, 1078-1231, or 1248-1297 as numbered in SEQ ID NO: 1 or corresponding positions thereof.

68. The method of embodiment 61, wherein the C-terminal fragment starts at a position between 1-529, 538-568, 580-685, 692-942, 948-1001, 1026-1051, 1078-1231, or 1248-1297 as numbered in SEQ ID NO: 1 or corresponding positions thereof and is a contiguous sequence that terminates at the C-terminus of the Cas9 polypeptide.

69. The method of embodiment 61, wherein the C-terminal amino acid of the N-terminal fragment is amino acid 1022, 1029, 1040, 1068, 1069, 1247, 1054, 1026, 768, 791, 792, 1248, 1052, or 1246 as numbered in SEQ ID NO: 1 or a corresponding amino acid thereof.

70. The method of embodiment 61, wherein the N-terminal amino acid of the C-terminal fragment is amino acid 1023, 1030, 1041, 1069, 1070, 1248, 1055, 1026, 769, 792, 793, 873, 907, 1249, 1053, or 1247 as numbered in SEQ ID NO: 1 or a corresponding amino acid thereof.

71. The method of any one of embodiments 67-70, wherein the deaminase is an adenosine deaminase.

72. The method of any one of embodiments 51-71, wherein the Cas9 polypeptide is a modified Cas9 and has specificity for an altered protospacer-adjacent motif (PAM).

73. The method of any one of embodiments 51-72, wherein the Cas9 polypeptide is a nickase.

74. The method of any one of embodiments 51-72, wherein the Cas9 polypeptide is nuclease inactive.

75. The method of any one of embodiments 51-74, wherein the contacting is performed in a cell.

76. The method of embodiment 75, wherein the cell is a mammalian cell or a human cell.

77. The method of embodiment 76, wherein the cell is a pluripotent cell.

78. The method of embodiment any one of embodiments 75-77, wherein the cell is in vivo or ex vivo.

79. The method of any one of embodiments 51-74, wherein the contacting is performed in a population of cells.

80. The method of embodiment 79, wherein the population of cells are mammalian cells or human cells.

81. A method for treating a genetic condition in a subject, the method comprising: administering to the subject a fusion protein comprising a deaminase flanked by a N-terminal fragment and a C-terminal fragment of a Cas9 polypeptide or a polynucleotide encoding the fusion protein, and a guide nucleic acid sequence or a polynucleotide encoding the guide nucleic acid sequence, wherein the guide nucleic acid sequence directs the fusion protein to deaminate a target nucleobase in a target polynucleotide sequence of the subject, wherein the N terminal fragment or the C terminal fragment binds the target polynucleotide sequence, thereby treating the genetic condition.

82. The method of embodiment 81, wherein the C-terminus of the N terminal fragment or the N-terminus of the C terminal fragment comprises a part of a flexible loop of the Cas9 polypeptide.

83. The method of embodiment 81 or 82, further comprising administering to the subject a guide nucleic acid sequence to effect deamination of the target nucleobase.

84. The method of any one of embodiments 81-83, wherein the target nucleobase comprises a mutation associated with the genetic condition.

85. The method of embodiment 84, wherein the deamination of the target nucleobase replaces the target nucleobase with a wild type nucleobase.

86. The method of embodiment 84, wherein the deamination of the target nucleobase replaces the target nucleobase with a non-wild type nucleobase, and wherein the deamination of the target nucleobase ameliorates symptoms of the genetic condition.

87. The method of any one of embodiments 81-83, wherein the target polynucleotide sequence comprises a mutation associated with the genetic condition at a nucleobase other than the target nucleobase.

88. The method of embodiment 87, wherein the deamination of the target nucleobase ameliorates symptoms of the genetic condition.

89. The method of any one of embodiments 81-88, wherein the target nucleobase is 1-20 nucleobases away from a PAM sequence in the target polynucleotide sequence.

90. The method of embodiment 89, wherein the target nucleobase is 2-12 nucleobases upstream of the PAM sequence.

91. The method of any one of embodiments 81-90, wherein the C-terminus of the N terminal fragment or the N-terminus of the C terminal fragment comprises an amino acid in proximity to the target nucleobase when the deaminase of the fusion protein deaminates the target nucleobase.

92. The method of any one of embodiments 81-90, wherein the N-terminal fragment or the C-terminal fragment comprises a RuvC domain.

93. The method of any one of embodiments 81-90, wherein neither of the N-terminal fragment and the C-terminal fragment comprises a HNH domain.

94. The method of any one of embodiments 81-90, wherein the flexible loop of the Cas9 polypeptide comprises an amino acid at a position between between 530-537, 569-579, 686-691, 768-793, 943-947, 1002-1040, 1052-1077, 1232-1248, or 1298-1300 as numbered in SEQ ID NO: 1 or corresponding positions thereof.

95. The method of embodiment 94, wherein the N-terminal fragment starts at the N-terminus of the Cas9 polypeptide and is a contiguous sequence that terminates at a position between V530-P537, F569-E579, D686-R691, Y943-D947, L1052-E1077, P1002-S1025, Y1232-G1247, or R1298-K1300 as numbered in SEQ ID NO: 1.

96. The method of embodiment 94, wherein the C-terminal fragment starts at a position between 530-537, 569-579, 686-691, 768-793, 943-947, 1002-1040, 1052-1077, 1232-1248, or 1298-1300 as numbered in SEQ ID NO: 1 and is a contiguous sequence that terminates at the C-terminus of the Cas9 polypeptide.

97. The method of embodiment 94, wherein the C-terminal amino acid of the N-terminal fragment is amino acid 1016, 1023, 1029, 1040, 1069, 1022, 1029, 1040, 1068, 1069, 1247, 1054, 1026, 768, 791, 792, 1246, 1247, 1248, or 1052 as numbered in SEQ ID NO: 1 or a corresponding amino acid thereof.

98. The method of embodiment 94, wherein the N-terminal amino acid of the C-terminal fragment is amino acid 1017, 1023, 1024, 1030, 1041, 1069, 1070, 1247, 1248, 1249, 1055, 1026, 769, 792, 793, 873, 907, or 1053 as numbered in SEQ ID NO: 1 or a corresponding amino acid thereof.

99. The method of any one of embodiments 81-98, wherein the deaminase is a cytidine deaminase.

100. The method of any one of embodiments 81-98, wherein the deaminase is an adenosine deaminase.

101. The method of any one of embodiments 81-100, wherein the Cas9 polypeptide is a modified Cas9 and has specificity for an altered PAM.

102. The method of any one of embodiments 81-101, wherein the Cas9 polypeptide is a nickase.

103. The method of any one of embodiments 81-101, wherein the Cas9 polypeptide is nuclease inactive.

104. The method of any one of embodiments 81-103, wherein the subject is a mammal.

105. The method of any one of embodiment 81-104, wherein the subject is a human.

OTHER EMBODIMENTS

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All patents and publications mentioned in this specification are herein incorporated by reference to the same extent as if each independent patent and publication was specifically and individually indicated to be incorporated by reference.

SEQUENCE LISTING (261 sequences)

SEQ ID NO: 1 - protein, 1368 aa, Streptococcus pyogenes [sequence omitted]

SEQ ID NO: 2 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 3 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 4 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 5 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 6 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 7 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 8 - protein, 16 aa, Artificial Sequence
  Description of Artificial Sequence: Synthetic peptide
SGSETPGTSESATPES

SEQ ID NO: 9 - protein, 60 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  MISC_FEATURE (1)..(60): This sequence may encompass 1-30 "Xaa Pro" repeating units
XPXPXPXPXPXPXPXPXPXPXPXPXPXPXPXPXPXPXPXPXPXPXPXPXPXPXPXPXPXP

SEQ ID NO: 10 - protein, 167 aa, Unknown
  Description of Unknown: Adenosine deaminase sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 11 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 12 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 13 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 14 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 15 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 16 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 17 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 18 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 19 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 20 - protein, 186 aa, Artificial Sequence
  Description of Artificial Sequence: Synthetic polypeptide
GSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 21 - protein, 186 aa, Artificial Sequence
  Description of Artificial Sequence: Synthetic polypeptide
TAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDP

SEQ ID NO: 22 - protein, 186 aa, Artificial Sequence
  Description of Artificial Sequence: Synthetic polypeptide
YRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQN

SEQ ID NO: 23 - protein, 186 aa, Artificial Sequence
  Description of Artificial Sequence: Synthetic polypeptide
MNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPG

SEQ ID NO: 24 - protein, 176 aa, Artificial Sequence
  Description of Artificial Sequence: Synthetic polypeptide
GSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFN

SEQ ID NO: 25 - protein, 173 aa, Artificial Sequence
  Description of Artificial Sequence: Synthetic polypeptide
GSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQ

SEQ ID NO: 26 - protein, 168 aa, Artificial Sequence
  Description of Artificial Sequence: Synthetic polypeptide
GSSGSETPGTSESATPESSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFN

SEQ ID NO: 27 - protein, 178 aa, Artificial Sequence
  Description of Artificial Sequence: Synthetic polypeptide
GSSGSETPGTSESATPESSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 28 - protein, 1410 aa, Artificial Sequence
  Description of Artificial Sequence: Synthetic polypeptide
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 29 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 30 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 31 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 32 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 33 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 34 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 1367 aa, Artificial Sequence
  Description of Artificial Sequence: Synthetic polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 39 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 40 - protein, 1210 aa, Unknown
  Description of Unknown: uncultured Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 41 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 42 - DNA, 766 bp, Petromyzon marinus
tgacacgacacagccgtgtatatgaggaagggtagctggatggggggggggggaatacgttcagagaggacattagcgagcgtcttgttggtggccttgagtctagacacctgcagacatgaccgacgctgagtacgtgagaatccatgagaagttggacatctacacgtttaagaaacagtttttcaacaacaaaaaatccgtgtcgcatagatgctacgttctctttgaattaaaacgacggggtgaacgtagagcgtgtttttggggctatgctgtgaataaaccacagagcgggacagaacgtggaattcacgccgaaatctttagcattagaaaagtcgaagaatacctgcgcgacaaccccggacaattcacgataaattggtactcatcctggagtccttgtgcagattgcgctgaaaagatcttagaatggtataaccaggagctgcgggggaacggccacactttgaaaatctgggcttgcaaactctattacgagaaaaatgcgaggaatcaaattgggctgtggaacctcagagataacggggttgggttgaatgtaatggtaagtgaacactaccaatgttgcaggaaaatattcatccaatcgtcgcacaatcaattgaatgagaatagatggcttgagaagactttgaagcgagctgaaaaacgacggagcgagttgtccattatgattcaggtaaaaatactccacaccactaagagtcctgctgtttaagaggctatgcggatggttttc

SEQ ID NO: 43 - protein, 145 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 44 - DNA, 10681 bp, Homo sapiens
agagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggcaataaatctagtttgctgcctaaagtttaaagtgctttccagtaagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaacgctgtttctataacaaaaattagccgggcatggtggcatgtgcctgtggtcccagctactagggggctgaggcaggagaatcgttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaactttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccatgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagatctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggctcaattctgtcttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 45 - protein, 198 aa, Homo sapiens [sequence omitted]

SEQ ID NO: 46 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 47 - protein, 198 aa, Canis lupus
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 48 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 49 - protein, 239 aa, Rattus norvegicus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 50 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 51 - protein, 430 aa, Rattus norvegicus
MGPFCLGCSHRKCYSPIRNLISQETFKFHFKNRLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 52 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 53 - protein, 384 aa, Pan sp.
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 54 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 55 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 56 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 57 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 58 - protein, 395 aa, Rattus norvegicus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFWRKKFQKGLCTLWRSGIHVDVMDLPQFADCWTNFVNPQRPFRPWNELEKNSWRIQRRLRRIKESWGL

SEQ ID NO: 59 - protein, 226 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAERFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 60 - protein, 490 aa, Pan sp.
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 61 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 62 - protein, 190 aa, Gorilla sp.
MNPQIRNPMKAMYPGTFYFQFKNLWEANDRNETWLCFTVEGIKRRSVVSWKTGVFRNQVDSETHCHAERCFLSWECDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 63 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 64 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 65 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 66 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 67 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 68 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 69 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 70 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 71 - protein, 229 aa, Rattus norvegicus [sequence omitted]

SEQ ID NO: 72 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 73 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 74 - protein, 224 aa, Rattus norvegicus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 75 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 76 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSFMIQVKILHTTKSPAV

SEQ ID NO: 77 - protein, 381 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKFNYDEFQHCWSKFVYSQRELFEPWNNLPKYYILLHFMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKKHVSLCIFTARIYRRQGRCQEGLRTLAEAGAKISFTYSEFKHCWDTFVDHQGCPFQPWDGLDEHSQDLSGRLRAILQNQEN

SEQ ID NO: 78 - protein, 182 aa, Homo sapiens
MDPPTFTFNFNNEPWWGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISFTYSEFKHCWDTFVDHQGCPFQPWDGLDEHSQDLSGRLRAILQ

SEQ ID NO: 79 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISFMTYSEFKHCWDTFVDHQGCPFQPWDGLDEHSQDLSGRLRAILQ

SEQ ID NO: 80 - protein, 4 aa, Artificial Sequence
  Description of Artificial Sequence: Synthetic peptide
SGGS

SEQ ID NO: 81 - protein, 24 aa, Artificial Sequence
  Description of Artificial Sequence: Synthetic peptide
SGGSSGSETPGTSESATPESSGGS

SEQ ID NO: 82 - protein, 32 aa, Artificial Sequence
  Description of Artificial Sequence: Synthetic polypeptide
SGGSSGGSSGSETPGTSESATPESSGGSSGGS

SEQ ID NO: 83 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 84 - protein, 24 aa, Artificial Sequence
  Description of Artificial Sequence: Synthetic peptide
SGGSSGGSSGSETPGTSESATPES

SEQ ID NO: 85 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 86 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 87 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 88 - protein, 18 aa, Artificial Sequence
  Description of Artificial Sequence: Synthetic peptide
KRTADGSEFESPKKKRKV

SEQ ID NO: 89 - protein, 16 aa, Artificial Sequence
  Description of Artificial Sequence: Synthetic peptide
KRPAATKKAGQAKKKK

SEQ ID NO: 90 - protein, 17 aa, Artificial Sequence
  Description of Artificial Sequence: Synthetic peptide
KKTELQTTNAENKTKKL

SEQ ID NO: 91 - protein, 19 aa, Artificial Sequence
  Description of Artificial Sequence: Synthetic peptide
KRGINDRNFWRGENGRKTR

SEQ ID NO: 92 - protein, 16 aa, Artificial Sequence
  Description of Artificial Sequence: Synthetic peptide
RKSGKIAAIVVKRPRK

SEQ ID NO: 93 - protein, 7 aa, Artificial Sequence
  Description of Artificial Sequence: Synthetic peptide
PKKKRKV

SEQ ID NO: 94 - protein, 30 aa, Artificial Sequence
  Description of Artificial Sequence: Synthetic polypeptide
MDSLLMNRRKFLYQFKNVRWAKGRRETYLC

SEQ ID NO: 95 - DNA, 20 bp, Homo sapiens
gaacacaaagcatagactgc

SEQ ID NO: 96 - DNA, 20 bp, Homo sapiens
ggacagcttttcctagacag

SEQ ID NO: 97 - protein, 166 aa, Unknown
  Description of Unknown: TadA sequence
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 98 - protein, 166 aa, Artificial Sequence
  Description of Artificial Sequence: Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 99 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 100 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 101 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 102 - protein, 1367 aa, Streptococcus pyogenes; identical to SEQ ID NO: 37

SEQ ID NO: 103 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 104 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 105 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 106 - protein, 4 aa, Artificial Sequence
  Description of Artificial Sequence: Synthetic peptide
GGGS

SEQ ID NO: 107 - protein, 5 aa, Artificial Sequence
  Description of Artificial Sequence: Synthetic peptide
GGGGS

SEQ ID NO: 108 - protein, 5 aa, Artificial Sequence
  Description of Artificial Sequence: Synthetic peptide
EAAAK

SEQ ID NO: 109 - protein, 166 aa, Unknown; identical to SEQ ID NO: 98
  Description of Unknown: TadA sequence

SEQ ID NO: 110 - protein, 186 aa, Unknown; identical to SEQ ID NO: 20
  Description of Unknown: TadA sequence

SEQ ID NO: 111 - protein, 186 aa, Unknown; identical to SEQ ID NO: 21
  Description of Unknown: TadA sequence

SEQ ID NO: 112 - protein, 186 aa, Unknown; identical to SEQ ID NO: 22
  Description of Unknown: TadA sequence

SEQ ID NO: 113 - protein, 186 aa, Unknown; identical to SEQ ID NO: 23
  Description of Unknown: TadA sequence

SEQ ID NO: 114 - protein, 176 aa, Unknown; identical to SEQ ID NO: 24
  Description of Unknown: TadA sequence

SEQ ID NO: 115 - protein, 173 aa, Unknown; identical to SEQ ID NO: 25
  Description of Unknown: TadA sequence

SEQ ID NO: 116 - protein, 168 aa, Unknown; identical to SEQ ID NO: 26
  Description of Unknown: TadA sequence

SEQ ID NO: 117 - protein, 178 aa, Unknown; identical to SEQ ID NO: 27
  Description of Unknown: TadA sequence

SEQ ID NO: 118 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 119 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 120 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 121 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 122 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDTGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 123 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 124 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 125 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 126 - protein, 1540 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 127 - protein, 1540 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 128 - protein, 1543 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 129 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 130 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 131 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 132 - protein, 1551 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 133 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 134 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 135 - protein, 1533 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSETPGTSESATPESSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 136 - protein, 1549 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 137 - protein, 1555 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSSGSETPGTSESATPESSGGSSIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 138 - protein, 1421 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 139 - protein, 1552 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 140 - protein, 1545 aa, Artificial Sequence
  Description of Artificial Sequence: Synthetic polypeptide
MSEVEFSHEYWMRHALTLAKRARDEREVPVGAVLVLNNRVIGEGWNRTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 141 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 142 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 143 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQSEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 144 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 145 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 146 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 147 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQLGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 148 - protein, 1484 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 149 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 150 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 151 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 152 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLAMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGNGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 153 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 154 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGDKPIREQAENIIHLFTLTNLGAPAAFKYFDTTIDRKRYTSTKEVLDATLIHQSITGLYETRIDLSQLGGD

SEQ ID NO: 155 - protein, 1454 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 156 - protein, 1420 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 157 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 158 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 159 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMITAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 160 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEITAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 161 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 162 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 163 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 164 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 165 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 166 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 167 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 168 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 169 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 170 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 171 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 172 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 173 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 174 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 175 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 176 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 177 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 178 - protein, 29 aa, Artificial Sequence
  Description of Artificial Sequence: Synthetic peptide
PKKKRKVEGADKRTADGSEFESPKKKRKV

SEQ ID NO: 179 - protein, 23 aa, Artificial Sequence
  Description of Artificial Sequence: Synthetic peptide
RKSGKIAAIVVKRPRKPKKKRKV

SEQ ID NO: 180 - protein, 21 aa, Artificial Sequence
  Description of Artificial Sequence: Synthetic peptide
  MISC_FEATURE (1)..(21): This sequence may encompass 1, 3 or 7 "Gly Gly Ser" repeating units
GGSGGSGGSGGSGGSGGSGGS

SEQ ID NO: 181 - protein, 1368 aa, Artificial Sequence [sequence omitted]

SEQ ID NO: 182 - protein, 229 aa, Mesocricetus auratus
MSSETGPVVVDPTLRRRIEPHEFDAFFDQGELRKETCLLYEIRWGGRHNIWRHTGQNTSRHVEINFIEKFTSERYFYPSTRCSIVWFLSWSPCGECSKAITEFLSGHPNVTLFIYAARLYHHTDQRNRQGLRDLISRGVTIRIMTEQEYCYCWRNFVNYPPSNEVYWPRYPNLWMRLYALELYCIHLGLPPCLKIKRRHQYPLTFFRLNLQSCHYQRIPPHILWATGFI

SEQ ID NO: 183 - protein, 236 aa, Pongo pygmaeus
MTSEKGPSTGDPTLRRRIESWEFDVFYDPRELRKETCLLYEIKWGMSRKIWRSSGKNTTNHVEVNFIKKFTSERRFHSSISCSITWFLSWSPCWECSQAIREFLSQHPGVTLVIYVARLFWHMDQRNRQGLRDLVNSGVTIQIMRASEYYHCWRNFVNYPPGDEAHWPQYPPLWMMLYALELHCIILSLPPCLKISRRWQNHLAFFRLHLQNCHYQTIPPHILLATGLIHPSVTWR

SEQ ID NO: 184 - protein, 236 aa, Oryctolagus cuniculus
MASEKGPSNKDYTLRRRIEPWEFEVFFDPQELRKEACLLYEIKWGASSKTWRSSGKNTTNHVEVNFLEKLTSEGRLGPSTCCSITWFLSWSPCWECSMAIREFLSQHPGVTLIIFVARLFQHMDRRNRQGLKDLVTSGVTVRVMSVSEYCYCWENFVNYPPGKAAQWPRYPPRWMLMYALELYCIILGLPPCLKISRRHQKQLTFFSLTPQYCHYKMIPPYILLATGLLQPSVPWR

SEQ ID NO: 185 - protein, 235 aa, Monodelphis domestica
MNSKTGPSVGDATLRRRIKPWEFVAFFNPQELRKETCLLYEIKWGNQNIWRHSNQNTSQHAEINFMEKFTAERHFNSSVRCSITWFLSWSPCWECSKAIRKFLDHYPNVTLAIFISRLYWHMDQQHRQGLKELVHSGVTIQIMSYSEYHYCWRNFVDYPQGEEDYWPKYPYLWIMLYVLELHCIILGLPPCLKISGSHSNQLALFSLDLQDCHYQKIPYNVLVATGLVQPFVTWR

SEQ ID NO: 186 - protein, 224 aa, Pongo pygmaeus
MAQKEEAAAATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEELEIQDALKKLKEAGCKLRIMKPQDFEYVWQNFVEQEEGESKAFQPWEDIQENFLYYEEKLADILK

SEQ ID NO: 187 - protein, 440 aa, Mus musculus
MQPQRLGPRAGMGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYISVPSSSSSTLSNICLTKGLPETRFWVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 188 - protein, 367 aa, Homo sapiens
MEPIYEEYLANHGTIVKPYYWLSFSLDCSNCPYHIRTGEEARVSLTEFCQIFGFPYGTTFPQTKHLTFYELKTSSGSLVQKGHASSCTGNYIHPESMLFEMNGYLDSAIYNNDSIRHIILYSNNSPCNEANHCCISKMYNFLITYPGITLSIYFSQLYHTEMDFPASAWNREALRSLASLWPRVVLSPISGGIWHSVLHSFISGVSGSHVFQPILTGRALADRHNAYEINAITGVKPYFTDVLLQTKRNPNTKAQEALESYPLNNAFPGQFFQMPSGQLQPNLPPDLRAPVVFVLVPLRDLPPMHMGQNPNKPRNIVRHLNMPQMSFQETKDLGRLPTGRSVEIVEITEQFASSKEADEKKKKKGKK

SEQ ID NO: 189 - protein, 388 aa, Rattus norvegicus
MEPLYEEYLTHSGTIVKPYYWLSVSLNCTNCPYHIRTGEEARVPYTEFHQTFGFPWSTYPQTKHLTFYELRSSSGNLIQKGLASNCTGSHTHPESMLFERDGYLDSLIFHDSNIRHIILYSNNSPCDEANHCCISKMYNFLMNYPEVTLSVFFSQLYHTENQFPTSAWNREALRGLASLWPQVTLSAISGGIWQSILETFVSGISEGLTAVRPFTAGRTLTDRYNAYEINCITEVKPYFTDALHSWQKENQDQKVWAASENQPLHNTTPAQWQPDMSQDCRTPAVFMLVPYRDLPPIHVNPSPQKPRTVVRHLNTLQLSASKVKALRKSPSGRPVKKEEARKGSTRSQEANETNKSKWKKQTLFIKSNICHLLEREQKKIGILSSWSV

SEQ ID NO: 190 - protein, 363 aa, Macaca fascicularis
MEPTYEEYLANHGTIVKPYYWLSFSLDCSNCPYHIRTGEEARVSLTEFCQIFGFPYGTTYPQTKHLTFYELKTSSGSLVQKGHASSCTGNYIHPESMLFEMNGYLDSAIYNNDSIRHIILYCNNSPCNEANHCCISKVYNFLITYPGITLSIYFSQLYHTEMDFPASAWNREALRSLASLWPRVVLSPISGGIWHSVLHSFVSGVSGSHVFQPILTGRALTDRYNAYEINAITGVKPFFTDVLLHTKRNPNTKAQMALESYPLNNAFPGQSFQMTSGIPPDLRAPVVFVLLPLRDLPPMHMGQDPNKPRNIIRHLNMPQMSFQETKDLERLPTRRSVETVEITERFASSKQAEEKTKKKKGKK

SEQ ID NO: 191 - DNA, 22 bp, Homo sapiens
ggaaaccttgaataagaatgga

SEQ ID NO: 192 - DNA, 20 bp, Homo sapiens
gagtccgagcagaagaagaa

SEQ ID NO: 193 - DNA, 20 bp, Homo sapiens
ggcccagactgagcacgtga

SEQ ID NO: 194 - protein, 198 aa, Mus musculus [sequence omitted]

SEQ ID NO: 195 - protein, 224 aa, Petromyzon marinus
MAGYECVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLTMHFSRIYDRDREGDHRGLRGLKHVSNSFRMGVVGRAEVKECLAEYVEASRRTLTWLDTTESMAAKMRRKLFCILVRCAGMRESGIPLHLFTLQTPLLSGRVVWWRV

SEQ ID NO: 196 - protein, 331 aa, Petromyzon marinus
MELREVVDCALASCVRHEPLSRVAFLRCFAAPSQKPRGTVILFYVEGAGRGVTGGHAVNYNKQGTSIHAEVLLLSAVRAALLRRRRCEDGEEATRGCTLHCYSTYSPCRDCVEYIQEFGASTGVRVVIHCCRLYELDVNRRRSEAEGVLRSLSRLGRDFRLMGPRDAIALLLGGRLANTADGESGASGNAWVTETNVVEPLVDMTGFGDEDLHAQVQRNKQIREAYANYASAVSLMLGELHVDPDKFPFLAEFLAQTSVEPSGTPRETRGRPRGASSRGPEIGRQRPADFERALGAYGLFLHPRIVSREADREEIKRDLIVVMRKHNYQGP

SEQ ID NO: 197 - protein, 209 aa, Petromyzon marinus
MAGDENVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLMMHFSRIYDRDREGDHRGLRGLKHVSNSFRMGVVGRAEVKECLAEYVEASRRTLTWLDTTESMAAKMRRKLFCILVRCAGMRESGMPLHLFT

SEQ ID NO: 198 - protein, 158 aa, Saccharomyces cerevisiae
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFIDERPQDWFEDIGE

SEQ ID NO: 199 - protein, 218 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRGLPPCLNILRRKQPQLTFFTIALQSCHYQRLPPHILWATGLK

SEQ ID NO: 200 - protein, 218 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQHYQRLPPHILWATGLK

SEQ ID NO: 201 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgactacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 202 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgacgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 203 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgacggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 204 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgacaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 205 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgacaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 206 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggcggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgactcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 207 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 208 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgaccaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 209 - DNA, 4620 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 210 - DNA, 21 bp, Homo sapiens
gtagggccttcgcgcacctca

SEQ ID NO: 211 - DNA, 4263 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgacggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 212 - DNA, 4656 bp, Artificial Sequence
  Description of Artificial Sequence: Synthetic polynucleotide
atgtccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggtctggtggttcttctggtggttctagcggcagcgagactcccgggacctcagagtccgccacacccgaaagttctggtggttcttctggtggttctgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 213 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacatgaaccaccgggtagaaatcacagaaggcatattggcggacgaatgtgcggcgctgttgtgttacttttttcgcatgcccaggcaggtctttaacgcccagaaaaaagcacaatcctctactgacggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 214 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctccatgaaccaccgggtagaaatcacagaaggcatattggcggacgaatgtgcggcgctgttgtgttacttttttcgcatgcccaggcaggtctttaacgcccagaaaaaagcacaatcctctactgacggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 215 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccatgaaccaccgggtagaaatcacagaaggcatattggcggacgaatgtgcggcgctgttgtgttacttttttcgcatgcccaggcaggtctttaacgcccagaaaaaagcacaatcctctactgacggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 216 - DNA, 4362 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgacgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 217 - DNA, 4260 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgacggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 218 - DNA, 4662 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggcactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgacggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgacccctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 219 - DNA, 4623 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggttctagcggcagcgagactcccgggacctcagagtccgccacacccgaaagttctggttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcagggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 220 - protein, 1541 aa, Artificial Sequence; identical to SEQ ID NO: 146
  Description of Artificial Sequence: Synthetic polypeptide

SEQ ID NO: 221 - DNA, 8913 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacggaggctctggaggaagcagctctgagacaggacctgtggccgtggatcccacactgcggagaagaattgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggcctgcgcgacctgatcagcagcggagtgacaatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagggctcttctggatctgaaacacctggcacaagtgagagcgccacccctgagagctctggcgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggtggaagcggaggatctggcggcagcaccaatctgagcgacatcatcgagaaagagacaggcaagcagctggtcatccaagagtccatcctgatgctgcctgaagaggtggaagaagtgatcggcaacaagcccgagtccgacatcctggtgcacaccgcctacgatgagagcaccgacgagaacgtgatgctgctgacctctgacgcccctgagtacaagccttgggctctcgtgatccaggacagcaacggcgagaacaagatcaagatgctgagcggcggctctggtggctctggcggatctacaaacctgtccgatattattgagaaagaaaccgggaaacagctcgtgattcaagagtctattctcatgctcccggaagaagtcgaggaagtcattggaaacaagcctgagagcgatattctggtccatacagcctacgacgagtctaccgatgagaatgtcatgctcctcaccagcgacgctcccgagtataagccatgggcacttgtcattcaggactccaatggggaaaacaaaatcaaaatgctcccaaagaaaaaacgcaaggtggagggagctgataagcgcaccgccgatggttccgagttcgaaagccccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccacc

SEQ ID NO: 222 - protein, 1837 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYGGSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGSSGSETPGTSESATPESSGDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLPKKKRKVEGADKRTADGSEFESPKKKRKV

SEQ ID NO: 223 - DNA, 8913 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccggaggctctggaggaagcagctctgagacaggacctgtggccgtggatcccacactgcggagaagaattgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggcctgcgcgacctgatcagcagcggagtgacaatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagggctcttctggatctgaaacacctggcacaagtgagagcgccacccctgagagctctggcaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggtggaagcggaggatctggcggcagcaccaatctgagcgacatcatcgagaaagagacaggcaagcagctggtcatccaagagtccatcctgatgctgcctgaagaggtggaagaagtgatcggcaacaagcccgagtccgacatcctggtgcacaccgcctacgatgagagcaccgacgagaacgtgatgctgctgacctctgacgcccctgagtacaagccttgggctctcgtgatccaggacagcaacggcgagaacaagatcaagatgctgagcggcggctctggtggctctggcggatctacaaacctgtccgatattattgagaaagaaaccgggaaacagctcgtgattcaagagtctattctcatgctcccggaagaagtcgaggaagtcattggaaacaagcctgagagcgatattctggtccatacagcctacgacgagtctaccgatgagaatgtcatgctcctcaccagcgacgctcccgagtataagccatgggcacttgtcattcaggactccaatggggaaaacaaaatcaaaatgctcccaaagaaaaaacgcaaggtggagggagctgataagcgcaccgccgatggttccgagttcgaaagccccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccacc

SEQ ID NO: 224 - protein, 1837 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAGGSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGSSGSETPGTSESATPESSGKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLPKKKRKVEGADKRTADGSEFESPKKKRKV

SEQ ID NO: 225 - DNA, 8913 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggaggctctggaggaagcagctctgagacaggacctgtggccgtggatcccacactgcggagaagaattgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggcctgcgcgacctgatcagcagcggagtgacaatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagggctcttctggatctgaaacacctggcacaagtgagagcgccacccctgagagctctggcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggtggaagcggaggatctggcggcagcaccaatctgagcgacatcatcgagaaagagacaggcaagcagctggtcatccaagagtccatcctgatgctgcctgaagaggtggaagaagtgatcggcaacaagcccgagtccgacatcctggtgcacaccgcctacgatgagagcaccgacgagaacgtgatgctgctgacctctgacgcccctgagtacaagccttgggctctcgtgatccaggacagcaacggcgagaacaagatcaagatgctgagcggcggctctggtggctctggcggatctacaaacctgtccgatattattgagaaagaaaccgggaaacagctcgtgattcaagagtctattctcatgctcccggaagaagtcgaggaagtcattggaaacaagcctgagagcgatattctggtccatacagcctacgacgagtctaccgatgagaatgtcatgctcctcaccagcgacgctcccgagtataagccatgggcacttgtcattcaggactccaatggggaaaacaaaatcaaaatgctcccaaagaaaaaacgcaaggtggagggagctgataagcgcaccgccgatggttccgagttcgaaagccccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccacc

SEQ ID NO: 226 - protein, 1837 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGGSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGSSGSETPGTSESATPESSGGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLPKKKRKVEGADKRTADGSEFESPKKKRKV

SEQ ID NO: 227 - DNA, 8913 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacggaggctctggaggaagcagctctgagacaggacctgtggccgtggatcccacactgcggagaagaattgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggcctgcgcgacctgatcagcagcggagtgacaatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagggctcttctggatctgaaacacctggcacaagtgagagcgccacccctgagagctctggcatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggtggaagcggaggatctggcggcagcaccaatctgagcgacatcatcgagaaagagacaggcaagcagctggtcatccaagagtccatcctgatgctgcctgaagaggtggaagaagtgatcggcaacaagcccgagtccgacatcctggtgcacaccgcctacgatgagagcaccgacgagaacgtgatgctgctgacctctgacgcccctgagtacaagccttgggctctcgtgatccaggacagcaacggcgagaacaagatcaagatgctgagcggcggctctggtggctctggcggatctacaaacctgtccgatattattgagaaagaaaccgggaaacagctcgtgattcaagagtctattctcatgctcccggaagaagtcgaggaagtcattggaaacaagcctgagagcgatattctggtccatacagcctacgacgagtctaccgatgagaatgtcatgctcctcaccagcgacgctcccgagtataagccatgggcacttgtcattcaggactccaatggggaaaacaaaatcaaaatgctcccaaagaaaaaacgcaaggtggagggagctgataagcgcaccgccgatggttccgagttcgaaagccccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccacc

SEQ ID NO: 228 - protein, 1837 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNGGSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGSSGSETPGTSESATPESSGIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLPKKKRKVEGADKRTADGSEFESPKKKRKV

SEQ ID NO: 229 - DNA, 8913 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggaggctctggaggaagcagctctgagacaggacctgtggccgtggatcccacactgcggagaagaattgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggcctgcgcgacctgatcagcagcggagtgacaatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagggctcttctggatctgaaacacctggcacaagtgagagcgccacccctgagagctctggcggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggtggaagcggaggatctggcggcagcaccaatctgagcgacatcatcgagaaagagacaggcaagcagctggtcatccaagagtccatcctgatgctgcctgaagaggtggaagaagtgatcggcaacaagcccgagtccgacatcctggtgcacaccgcctacgatgagagcaccgacgagaacgtgatgctgctgacctctgacgcccctgagtacaagccttgggctctcgtgatccaggacagcaacggcgagaacaagatcaagatgctgagcggcggctctggtggctctggcggatctacaaacctgtccgatattattgagaaagaaaccgggaaacagctcgtgattcaagagtctattctcatgctcccggaagaagtcgaggaagtcattggaaacaagcctgagagcgatattctggtccatacagcctacgacgagtctaccgatgagaatgtcatgctcctcaccagcgacgctcccgagtataagccatgggcacttgtcattcaggactccaatggggaaaacaaaatcaaaatgctcccaaagaaaaaacgcaaggtggagggagctgataagcgcaccgccgatggttccgagttcgaaagccccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccacc

SEQ ID NO: 230 - protein, 1837 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGGSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGSSGSETPGTSESATPESSGGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLPKKKRKVEGADKRTADGSEFESPKKKRKV

SEQ ID NO: 231 - DNA, 8913 bp, Artificial Sequence
  Description of Artificial Sequence: Synthetic polynucleotide
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggcggaggctctggaggaagcagctctgagacaggacctgtggccgtggatcccacactgcggagaagaattgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggcctgcgcgacctgatcagcagcggagtgacaatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagggctcttctggatctgaaacacctggcacaagtgagagcgccacccctgagagctctggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggtggaagcggaggatctggcggcagcaccaatctgagcgacatcatcgagaaagagacaggcaagcagctggtcatccaagagtccatcctgatgctgcctgaagaggtggaagaagtgatcggcaacaagcccgagtccgacatcctggtgcacaccgcctacgatgagagcaccgacgagaacgtgatgctgctgacctctgacgcccctgagtacaagccttgggctctcgtgatccaggacagcaacggcgagaacaagatcaagatgctgagcggcggctctggtggctctggcggatctacaaacctgtccgatattattgagaaagaaaccgggaaacagctcgtgattcaagagtctattctcatgctcccggaagaagtcgaggaagtcattggaaacaagcctgagagcgatattctggtccatacagcctacgacgagtctaccgatgagaatgtcatgctcctcaccagcgacgctcccgagtataagccatgggcacttgtcattcaggactccaatggggaaaacaaaatcaaaatgctcccaaagaaaaaacgcaaggtggagggagctgataagcgcaccgccgatggttccgagttcgaaagccccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccacc

SEQ ID NO: 232 - protein, 1837 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGGGSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGSSGSETPGTSESATPESSGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLPKKKRKVEGADKRTADGSEFESPKKKRKV

SEQ ID NO: 233 - DNA, 28 bp, Homo sapiens
ggcctccgtatcactctctgactggggt

SEQ ID NO: 234 - DNA, 28 bp, Homo sapiens
gtaactgaacccctgcaatcaatgggat

SEQ ID NO: 235 - DNA, 27 bp, Homo sapiens
gccacagacttttccatttgcaggagt

SEQ ID NO: 236 - DNA, 28 bp, Homo sapiens
gcgaaaggctcgcggcgaaggaaggaat

SEQ ID NO: 237 - DNA, 27 bp, Homo sapiens
gcctggcagatgagaaccaggaggaat

SEQ ID NO: 238 - DNA, 28 bp, Homo sapiens
gtattactattattatctgagatggggt

SEQ ID NO: 239 - DNA, 27 bp, Homo sapiens
gccacagtgggaggggacatggggaat

SEQ ID NO: 240 - DNA, 27 bp, Homo sapiens
gccctgatctgcactgaacagaggggt

SEQ ID NO: 241 - DNA, 28 bp, Homo sapiens
gcctcaagtctggttattttagggggat

SEQ ID NO: 242 - DNA, 27 bp, Homo sapiens
ggtcgacccttggtatccatgggggat

SEQ ID NO: 243 - DNA, 27 bp, Homo sapiens
gaaagagacagagaaggggcagggggt

SEQ ID NO: 244 - DNA, 28 bp, Homo sapiens
gagtgggaactttctgatgccatggaat

SEQ ID NO: 245 - DNA, 28 bp, Homo sapiens
gtgggactgatcccttaatgtgtggggt

SEQ ID NO: 246 - DNA, 27 bp, Homo sapiens
gcccagctccagcctctgatgaggggt

SEQ ID NO: 247 - DNA, 28 bp, Homo sapiens
gaaggctttactgtattacagaaggggt

SEQ ID NO: 248 - DNA, 27 bp, Homo sapiens
ggagccagagaccagtgggcagggggt

SEQ ID NO: 249 - DNA, 28 bp, Homo sapiens
gctttccttagctgtaaaagaaagggat

SEQ ID NO: 250 - DNA, 28 bp, Homo sapiens
gagaagaaaccagggaacaggtaggagt

SEQ ID NO: 251 - DNA, 28 bp, Homo sapiens
gatgtgtctactgttacttacaaggaat

SEQ ID NO: 252 - DNA, 27 bp, Homo sapiens
gaccaggtcagcaaacatgtttggaat

SEQ ID NO: 253 - DNA, 28 bp, Homo sapiens
gcacccaggggttctgcagagcagggat

SEQ ID NO: 254 - DNA, 27 bp, Homo sapiens
gcccagcaattcactgtgaagagggat

SEQ ID NO: 255 - DNA, 27 bp, Homo sapiens
gaccaaaacgagggacatttaggggat

SEQ ID NO: 256 - DNA, 28 bp, Homo sapiens
gctcctctcacccttatgactcagggat

SEQ ID NO: 257 - DNA, 28 bp, Homo sapiens
gactcagcgcccctgccgggcctgggat

SEQ ID NO: 258 - DNA, 27 bp, Homo sapiens
ggtcgtagccagtccgaaccccggagt

SEQ ID NO: 259 - DNA, 27 bp, Homo sapiens
gcattccactccgtccgcctccggagt

SEQ ID NO: 260 - DNA, 28 bp, Homo sapiens
gggtacctgagtggggtgcatttggggt

SEQ ID NO: 261 - DNA, 20 bp, Homo sapiens
ggcactgcggctggaggtgg

What is claimed is:

1. A fusion protein comprising a deaminase inserted within a flexible loop of a Cas9 polypeptide, wherein the fusion protein comprises the structure:

NH2-[N-terminal fragment of a Cas9]-[TadA adenosine deaminase]-[C-terminal fragment of a Cas9]-COOH, wherein each instance of "]-[" is an optional linker, wherein the TadA adenosine deaminase is inserted between amino acid positions 768-769, 1022-1023, 1026-1027, 1040-1041, 1068-1069, or 1247-1248, as numbered in SEQ ID NO: 1, and wherein the TadA adenosine deaminase of the fusion protein deaminates a target nucleobase in a target DNA molecule and effects reduced deamination at non-target sites compared with an end-terminus fusion protein comprising the TadA adenosine deaminase fused to an N-terminus or C-terminus of a Cas9 polypeptide.

2. The fusion protein of claim 1 further comprising a nuclear localization signal.

3. The fusion protein of claim 1, wherein the fusion protein is in complex with a guide nucleic acid to effect deamination of a target nucleobase.

4. A cell comprising the fusion protein of claim 1.

5. A kit comprising the fusion protein of claim 1.

6. A method for base editing comprising contacting a polynucleotide sequence with the fusion protein of claim 1, wherein the deaminase of the fusion protein deaminates a nucleobase in the polynucleotide, thereby editing the polynucleotide sequence.

7. The method of claim 6, wherein the contacting is performed in a cell.

8. A fusion protein comprising a deaminase inserted within a Cas9 polypeptide, wherein the fusion protein comprises the structure:

NH2-[N-terminal fragment of a Cas9]-[TadA adenosine deaminase]-[C-terminal fragment of a Cas9]-COOH, wherein each instance of "]-[" is an optional linker, wherein the Cas9 polypeptide comprises a deletion of amino acid positions 794-905, as numbered in SEQ ID NO: 1, wherein the TadA adenosine deaminase is inserted at the deletion position, and wherein the TadA adenosine deaminase of the fusion protein deaminates a target nucleobase in a target DNA molecule and effects reduced deamination at non-target sites compared with an end-terminus fusion protein comprising the TadA adenosine deaminase fused to an N-terminus or C-terminus of a Cas9 polypeptide.

9. A polynucleotide encoding a fusion protein, wherein the fusion protein comprises:

A) a TadA adenosine deaminase inserted within a flexible loop of a Cas9 polypeptide, wherein the fusion protein comprises the structure:

NH2-[N-terminal fragment of a Cas9]-[TadA adenosine deaminase]-[C-terminal fragment of a Cas9]-COOH, wherein each instance of "]-[" is an optional linker, wherein the TadA adenosine deaminase is inserted between amino acid positions 768-769, 1022-1023, 1026-1027, 1040-1041, 1068-1069, or 1247-1248, as numbered in SEQ ID NO: 1; or B) a deaminase inserted within a Cas9 polypeptide, wherein the fusion protein comprises the structure:

NH2-[N-terminal fragment of a Cas9]-[TadA adenosine deaminase]-[C-terminal fragment of a Cas91-COOH, wherein each instance of "1-" is an optional linker, wherein the Cas9 polypeptide comprises a deletion of amino acid positions 794-905, as numbered in SEQ ID NO: 1, wherein the TadA adenosine deaminase is inserted at the deletion position; and wherein the TadA adenosine deaminase of the fusion protein deaminates a target nucleobase in a target DNA molecule and effects reduced deamination at non-target sites compared with an end-terminus fusion protein comprising the TadA adenosine deaminase fused to an N-terminus or C-terminus of a Cas9 polypeptide.

10. An expression vector comprising the polynucleotide of claim 9.

11. A method for editing a target nucleobase in a target polynucleotide sequence, the method comprising: contacting the target polynucleotide sequence with a fusion protein comprising a TadA adenosine deaminase inserted within a Cas9 polypeptide, wherein the fusion protein comprises the structure:

NH2-[N-terminal fragment of a Cas9]-[TadA adenosine deaminase]-[C-terminal fragment of a Cas91-COOH, wherein each instance of "1-" is an optional linker, wherein the Cas9 polypeptide comprises a deletion of amino acid positions 794-905, as numbered in SEQ ID NO: 1, wherein the TadA adenosine deaminase is inserted at the deletion position, and wherein the TadA adenosine deaminase of the fusion protein effects reduced deamination at non-target sites compared with an end-terminus fusion protein comprising the TadA adenosine deaminase fused to an N-terminus or C-terminus of a Cas9 polypeptide.

12. A method for editing a target nucleobase in a target polynucleotide sequence, the method comprising: contacting the target polynucleotide sequence with a fusion protein comprising a deaminase inserted within a flexible loop of a Cas9 polypeptide, wherein the fusion protein comprises the structure NH2-[N-terminal fragment of a Cas9]-[TadA adenosine deaminase]-[C-terminal fragment of a Cas9]-COOH, wherein each instance of "]-[" is an optional linker, wherein the TadA adenosine deaminase is inserted between amino acid positions 768-769, 1022-1023, 1026-1027, 1040-1041, 1068-1069, or 1247-1248, as numbered in SEQ ID NO: 1, and wherein the TadA adenosine deaminase of the fusion protein effects reduced deamination at non-target sites compared with an end-terminus fusion protein comprising the TadA adenosine deaminase fused to an N-terminus or C-terminus of a Cas9 polypeptide.

13. A method for treating a genetic condition in a subject, the method comprising: administering to the subject a fusion protein comprising a TadA adenosine deaminase inserted within a Cas9 polypeptide, wherein the fusion protein comprises the structure:

NH2-[N-terminal fragment of a Cas9]-[TadA adenosine deaminase]-[C-terminal fragment of a Cas9]-COOH, wherein each instance of "]-[" is an optional linker, wherein the Cas9 polypeptide comprises a deletion of amino acid positions 794-905, as numbered in SEQ ID NO: 1, wherein the TadA adenosine deaminase is inserted at the deletion position, and a guide nucleic acid or a polynucleotide encoding the guide nucleic acid, wherein the guide nucleic acid directs the fusion protein to deaminate a target nucleobase in a target DNA molecule of the subject, , wherein the genetic condition is caused by the target nucleobase, which comprises a single nucleotide polymorphism or point mutation at a single locus in the target DNA molecule of the subject, and wherein the TadA adenosine deaminase effects reduced deamination at non-target sites compared with an end-terminus fusion protein comprising the TadA adenosine deaminase fused to an N-terminus or C-terminus of a Cas9 polypeptide, wherein deamination of the target nucleobase ameliorates symptoms of the genetic condition, thereby treating the genetic condition.

14. The method of claim 13, wherein the deamination of the target nucleobase replaces the target nucleobase with a wild type nucleobase.

15. The method of claim 13, wherein the deamination of the target nucleobase replaces the target nucleobase with a non-wild type nucleobase.

16. A method for treating a genetic condition in a subject, the method comprising: administering to the subject a fusion protein comprising a TadA adenosine deaminase inserted within a flexible loop of a Cas9 polypeptide, wherein the fusion protein comprises the structure NH2-[N-terminal fragment of a Cas9]-[TadA adenosine deaminase]-[C-terminal fragment of a Cas9]-COOH, wherein each instance of "]-[" is an optional linker, wherein the TadA adenosine deaminase is inserted between amino acid positions 768-769, 1022-1023, 1026-1027, 1040-1041, 1068-1069, or 1247-1248, as numbered in SEQ ID NO: 1, and a guide nucleic acid or a polynucleotide encoding the guide nucleic acid, wherein the guide nucleic acid directs the fusion protein to deaminate a target nucleobase in a target DNA molecule of the subject, wherein the genetic condition is caused by the target nucleobase, which comprises a single nucleotide polymorphism or point mutation at a single locus in the target DNA molecule of the subject, and wherein the TadA adenosine deaminase of the fusion protein effects reduced deamination at non-target sites compared with an end-terminus fusion protein comprising the TadA adenosine deaminase fused to an N-terminus or C-terminus of a Cas9 polypeptide, wherein deamination of the target nucleobase ameliorates symptoms of the genetic condition, thereby treating the genetic condition.

* * * * *